United States Patent 12,576,115 (BACTERIAL COMPOSITIONS FOR TREATING AND PREVENTING HALITOSIS) - sequence listing, part 30

SEQ ID NO: 50 - DNA, 1944907 bp, Pediococcus acidilactici
  source 1..1944907: mol_type = genomic DNA
tggactcttcggtcttggtaagaagcgtaaacgtcacgatgaagaataatcgtcgactttaaagttaagaagagttattcgttcaacggttagaaaaaaatacaagtttaaaaaaatacctgtagttagtggtaggtggtaactatcgctaacggcaggtattttttagtaaataaaatgaatatttgaagagcgtggaaacatagtttttggtttttgaacgtttttgttataaacactattttcttgatatattttaagagttaaatattttatactgcaattgtaagagaattgaaagcgattactcaaagaggggagagttacttggaagaaataaagttaagaaaattgtttaatgatttaagtgatgcagagaaggtcagtcagactgttcaattgaatggagacctttttgtggaaagtggggtgatgagtactggaccaaaaacggatttaggattaccagctgattttaattattatgaaatcgggtcaatttataacgttaacgaccatcgcaagttgaaaaaattgcaaacggaagtattggaaaagagccgtcatcggataccgctattattcatgtcagatattatttatggatttcgaacgatttttccaatgccgttagcgcaagcaggctcgtataattttgatttaattcaacgagcggcagcggtaactgcaaaagaaagttaccaaaatggtcttcacgtagttttttcgcccatgctcgatttggtgcgcgatccgcgttggggacgagtaatggaatcacctggagaagatgtatacactgccaaagaatttggacgacacgtcgtccgcgggtatcaaggggacttggctgacggaaaaattacccgtaaccacgttgcagcttgcatcaagcattttgcggcttacggtgctccagaaagcggtcgcgagtacaatgcggtggagttgtcttaccaaaaactctataatgagtatttgcaaccataccaagccgcaattgaagcaaaagctcaactagtaatgactgccttcaatcttttaaatggtgtaccagcaactgggaaccggtggttaaatcgggaagttcttcgagatcgatttggatttgaaggagtgttggatgcagattattctgcaattgcagaattagtaaatcacggctacgcagccaattcccaagaagccgctcagaaagcgttgcgtgcgggagtagacttggatatgatgacggcggtttatgccaatggattaccgaaggtgcttaaaaatcctgagatgcgtcaattattggatgaggcagtttggcgaatcctagttttaaagaataagttgggactatttgaaaatccttttcgtggattggatgaaccagccactggtaagattcttgctgaggaagattgagctttagctgcccaattggttgaggaaagcagcgttttattgaaaaataaaagcgctttaccactccgacaagaccaaaaaatcgccgtgattggtccgtatggggaaagcaaacttaccctgggcttctgggcttcagtaagcggtaaatctaccgacgtagttcctttaaaagagggactacaagcagaatttaatcccgcacagttatcgtttagtcgaggatataacttgtttgattcttataagccttttggacccttaaaacaagggattgaaatggttaatggcccaattgaggacgaaaacttactcttacaacaagctgaaaaacaggcagccgcggcggacgtagtggtcttgaccattggagaaaactttttagaaagtggagaaggtgcagctaaagcacatttgaccctgccggttaagcaaaagcgacttattcaagcagttgctaagcaggggaaaccgattgtgggcatcgtctataccggtcggccactagtgttaactgatgtagaaccgtactttgatagtttgttattggtttggttccctggaattatgggtggaaccggaattgctaatttactatctggtaaggcaagtccttcggcgcggttatcaatgacttttccacggagtgaaggacaattgccaatttatcaagctcgcaccccaaccggccgtccgctgggagaaagcaaccattcggaccggttcgtttccaaatacattgatgaaagtaacgagccattatatccatttggcagcggacttagttatgtaaggttcacgggacgttggcgagaattacaccaagacgcaacgactttaaagggaaaatttgaagtggaaaatttaagtgaccgagccgcagcgacggtggttcagatttatctcaagcaatttccagcggagattgtccaaccagtcaaacggttagttaaggccgttaaggttcagtttactggagctggtaagcaagtaattgatgtcgaaatgccggtggcagaattagcatactttgacaatcagggtgaaaaacatcttgagcacactgagtaccagttccaactcgatattttaggggaaacctcagagattaacttgaaactaaattaaaattaggtaaaggagtatcaaaaatgaacaatttagagaaatttttaaatgacaaattattgccaatttcagaaaaattacagaaaaataaaattctagcagcgttaatggaagggtttattcggaccagtccaattacgttgggaattgcgttaatcaccattatcggaaactttccggttccaggttggactcaatttttaactaagattggaattttccaacatgtcgaagcgattactaacggggctaccggagttttctcgctatacgtagtgtatagtttagccttttcttacgcgaagcaattgaaaactaacgaacggaatgcttcattaatttcgttagccagtttcatcatgttaatgccgcaatcggttaccaccacggtaatgaagagcggccacacgactagccaagcaattggagcattaaaacttgattatttaggcggacagggactatttattggaatgattttagcattggtaatcactcgactttacgcagctctttccaaaaagaacttgatgatcaagcttccagaaagcgttccgccaatggttacccaatctttatctccagtgttcgtggttaccatcatcttcgtactagtattcattgtccgggtattgtttggtttgactccttcgggaactatcttccaattcttcgttgacgcaatcaatgctccgttaaattcattagttgctagtccgctttcaattatcttgataatggaactcttagcaattttctggttctttggaatccacaacgctgttttacaaggacctttaggcgcagttagcatgaccatgatcgttggtaacatcactgctttccaacatggccaaaaattaccatacttgttaccttccgtaatttacatgggaatgtacgcagcgggattcatgggcttagttacctttgtaatgattcgcagtaagtcaactaagatgaagcaattaggtaaattagcatttattccatcactgtttaatatttcagaaccgattatgtttgggatgccaattattttgaacccgctcttctttattccgcaagtatttacgcaattaattgcgggctttgtaacctggggcttaacgaccactattttaccaatttcacttaacccaacgatgtcgctactcccatggactacgccaactttcgttaagatgccgttttcagggggcttaaactacaccatcctaatggtaatttgtatggcaattggaattttaatgtggtacccattcattaaggttgctgacaacaaagaataccgcttagaaatggaactcgctaaaaaagaacagactgaaactgcagcggaaaaagaagcggaagcagttactgaatagtgtacaaacgtggggaaaacaaatgaaaaagttaagtattgatattgggggatccagcgttaaagcggggattgtagccgacggtacggttagtgaccgccaaaaattttcgacccccaacacctatttagattttaaaatattacttgaagaccttatcaaacggtaccggacggtagatgattttgaattaattgcggttgccgttccgggcaccgttgaaaatgatggaaccgtccggtttggcggggcaatcccatatcttgaccagattaatctaaagacggttgtgaacaaaatgtctgggttaccggtcacaatcgaaaatgacgctaaggcggcaaccttaggtgaaatgcgcaggggtaacttgcgggaaattcgtaatggggccgcactcattttaggaaccggggttggattaggaatttgtttgaatggctccttgtataaaggtagccatcaccaagcaggcgaattaagtttcatgatgcgggatcggcgcgttcaatcaggcgactcgtttgttggaattggcttatccgccgttaacctagtggaagatctagcaagcattttaaacaccgaagctgacggagctaccgtatttgcccggttgaaccagcaagctaacgcggacgctaaccaacgttttgcggactattgctttggggtcgcacaaatttgtttcaatttacaaactgtactagacttagacaaaatcgtcatcggtggcggcattagcagtcagcccctattaatcgaaaaggttcaggaagcgtaccaacaaattttaaatacatccccaattattaagaagacggttaagcaaattgacatcacggacgctttttttaaggcgaatgccaacttaattggggctgcggaggtaattaattatggctaaaacatttccagaaaatttcttgtggggagcttccaccagtgcttatcaagttgaaggcgggtggaacgccgatggaaagggaccttccgttcaagatgtaaaggacattccagcgggaaccactgatttcaaggtcgcggtggaccactatcaccggtttgctgaagacgtaaagctttttaaagaattagggttaaaggcctaccgcttttcaatcgcgtggagccgggtcatgcctaatggtaaagtgaatccagaaggcattaaattttaccgtaacctaattaatttgcttaagggaaatcagattgaaccaattgttacggtatttcattttgatttacctgcggaaattgaccaagctggcggatggaaaaatcgagagaccattcagcaattcgcggactactgcgacgtcttatttgaaaactttggccaagacgttaagtactggcagacgataaacgagcaaaacgtaatggcacttgctggttcggtaattgggactagccaaaaaagcatgcgtgaaaaattccaggaaaatcatcacatgctcgttgcttaagcattagtaaccaaacactatcatgaacaaggttatccaggaaaaattgggccggcacccaacattgctagtgtctatgctgcttctgaccgtccagcggaccagttggcagcgcttaacatgagtgcgttacgcaactggttgttcttagacgtggcagtttacggacgctacaaccacaatgcttggcatattttagaaagtattggagctgcgccagtggttacggaaaccgaccgggaaattttagcggcggggacgtgcgactacattgcctttaactactacaacaccatgacggttgcggcatactttgctaaagaaaataaaattgaccaacaatcggggtttgggattccaggatttttccaaacggtcaccaacgaacatttaccattgactgaatttgggtggccaatcgatcctcaaggattccggtttaccctgaacgaaatctactcccgctaccatttgccagtgttaattaccgaaaatggaatcggcgcgcatgatgaacttacggaagaccatcaaattcatgatcagtatcgaattgattatctaaaacagcacatccaacaaatggaattagctatccaagacggcgttgaagtgatcggatattgtccttggagtgcaattgatttaattagcacgcacgaagggatgcagaaacgttacggttttatttacgttaaccggaccgacgacgagcttaaagatttagcgcgttataaaaaggatagctttaattggtaccaacgggtaattgaacataacggaatagttgactagtttaaggaagggggttccgattatcaaaaaaagtaattacgtatttgacgagtcagccaatacgggaatgacggtgtatttacaaacggatttaagtgctccccggccgctaattttaataattccgggaggcggttacaatttttgtagtgagcgggaagctgaaccggtggccttagcttttttggcaaaaggctaccatgccgcggtattacgttatcacgtgggagaatttcgcgattttcaagcagctttgaatgatggtcaactggctttacagcaaattaaacaaattgcttcaaacgctgcaattgaggtggataaaattgcggtagtgggcttttctgcaggtgggcatttagcgtcggcgatgtcgacaatgctaagcgaaaagcccagcctatgtgttttaggctatccggcaattttagattcgtttgccgaggtaatgcaggtgcaagccccttccttagaccagcaagttaccgcaacgactccgccaacctttttatttaccacctttcaagataatgtggtaccggtggaaaattcgttgttatatctgcgagctttagaggagcacgacgttttgtttgaggcccacgtttttcaagaaggtaagcatgggctttcgttggggactccggcagtgggaaaaaatgacccgcggtttgcccagtggtttgacttatgctgcgagtggatggaaattaattggcagaagacgtctaagccggcggagtatccggatgttttaaccatgccggtcggcgaactaatgcgcaacgcagctaataaaaaaattctcttagagtattttccagtttggcaagatcgtagccggtataaaatcgttcgtaagtttaaccttacggaacttcacgaggtggcgccgcaaatttttaatgcaacgattttgcaacaactacaaagtaaattaacgatgggggaaggagcaaattaataatgaaaagtatcatcaccgacgaaagttggcggccaacgaccgcgcttaaccaaccgcttccgccgtccattgcacaagtgcacagtttcaaaaacagtaaggcagcatttatgctgttgcttaacgacggacaccgcaatcactatacgttaggcacccagttttcaattccagacgatttggaaactccgatgtaccgggttgcgtttgaaactgagttgcctttgacaactaattttgtggaatactatttggggaaggatgacgtcgcctatgccgataaacttttaagcgaggccagtcatacctatccaggaaaccagtgggccccgatttatgtagaaattccggttagtcaaacggtaaaaacgggtaaccaccctgtgaaaatcaaaatttacaaaactagtttaactggagcagaagttttggtggccgaaaaagaggtccaaattatggtggctgattttgcactaacatccgaaccaacgaaggattttcaccttgacatctggcagcagccctctaatttagcccgtacgttccacgtacccatgtggggcgaccagcactttgcgttaattgatgaaatggccgaaaaactagcgcaaattggacaaaaaacagtaacggtgattgctggtgaaattccttggaagggatggtttaactacattgtcaaggactaccccgcaaacctatacgaatattcaatggtccaggttagtaaagatttcacaggtaagttgaaatgtgactttaccattttggatcgttacctcgctagctttgctaaacgggggattgaccaagagattgaaatttttggcctactaggagtttggaagccaccattctttccacaggtaaccattaaagattatccagaaaatttagtggttcgttacctaaacgaaactaccgaaacgatgcaatttatcgataacgtagcggatttaacgaactacgttaaagcactttgcgatcatctaaaagatttgcaagtttgggagaaagttcggctaattgcagacgagcctaaacaagcacagttaaaagaatttaaggacgcattatctgcgttgaaacagatggtgccagatctcaaggttaaggttgcttttgataaggagccgatcttaaacgaattagctccgctagtggataccttggcaacttcgttttattgtactagtcaattcggcagtcaattgcaagccagccatcctggggaagtccagtactatatttgcaattacccagaccatcccaataccttcttgcacagcccgttattggaaacccggttgcaaggtacgttgacagcattcttaccggtaaatggcttactgcggtgggcatttaactgctggccaagcaacgcccgcgaggatattcgttacaacaccagttcgttgccgatcggggataattgtttggtgtacccaggagaaaatgggcatttactattatcgttgcgttataagcagttggaacgggcggtcgaggactttagtttaatcaagtctgcaaaggctacggatgaaaaacggaccacggcgatcttagaacattttttgggagaaacagctcctcagaaatggatggaagatagtcattgtgcagcgccaaaattgtttaggcaaactgcgaacgattttaagcaaatgcgggatgaattagttgcggtgatcaataacgacgtttaagagaataatcctagtgaaaatggaagatactaattatgcgatggataaaacgattgttaatcataataccagctttggtaattttattaattggcggagcaatgctaattaacgcgttaacgccccgaccaatcagtttattaacccggcaacaatttgatacgtccaaaaaacatcaagtgtacccccggcccaaaaagttcaagcaaaaaacggctgggctaacggtgcaaaaaaacgttaagtacggaaagcacttgagcaagagtgtcatggacgtgtatttaccgccccatgctagtaaaaggcccgtgcttttctggatgcacggcggtgcctatgtcggcggggataaacgcgattgtcaggattatctaaaacttttgagcgcggatactaaccaagtcgtggtgaatattaactacgctcttgcaccagaaaggcatcatgcgacaccagttagacagctcaaccaagctattcaggcaaccaagcaaaaatacggaaaacaaattgattggtccaatgtcaccattggcggagattcagctggggcgcaaataagcagtgaatatgttttagctttgcaaaataaaaagattcgtaaaatggatcaagtgcagccggttttaaaaagtcagcaagttaaaaagtttgtgtcgctatcgggattgctagaaccccaaaagtttacccaggttagtgatcgcacatctagcttcctatatgctaaatgcggctgggcgtattttgctgacaagcattttgaaaaaaagaagtccattcgtgacttatcaattatcagcaacgttaaagattgggcgccgaagactttcttgactgatggcaacacgaatacctttacaaagcaaatgaatgccactgctaaggcaattagtgatcataacggacaggtgactaaagtgagttatccgaagaaaaccgccaagttgaatcacgagtatcaatttgactttagtaataaagaagcccaagaaacctatgctaagttggtggattttttaagcgaatagctattaagggggcttaacgctggcgataaattttttgtgttttaaaagcggctaaccatgagtacttctcaagaaagtgaaaattcttgagaagtactttttagttcctatacaaaaataagccctttacagaagttgcaacattaattatgcaatagaaaacgttttccgcgagacgataagcacgtatagtacatattgaaaggaggtgaaccgaaataatgcatgatcgggaagcggaaattgtcgaatttttaattcatcacggagtggtccattacgaacaaatcgctaaagcgaccaagttgtcgaaaagaagtattgcaaattacctagatattatcgaaaatgacgctcagccctttaacttgaagttaacaagaaagccaaacgtgggaatttatttaaacggacagttgcgcaataaacaagatttcttaacggcgttaaagttacatagcggttttacttcgaaggaagcgcggattcgctatctactaatcaaattgctggatgcggaccgaagctatacgctaaacgagctggccgatgacctatacgttagccgaagcactttggaaagtgattttaagcagattcgggaattctttaatgagcatcacgtcaagatcaagcggggggcgaatggaattgccattcgggcttctggcgaacaacgcgagcggttaatggcaaaaattttgaaaatgtattggggccaaaatatttccgtgatccaggacgctaatggacaaattgcttccacccttaaattgccggattatttactaaatttttttcctgccgaccttgtccaagcagttttggccggaattacggattttatggtgaccagtcgcttagaattaaccgactacgatcttcagtctttagcgattcatttaatcattaatacggatgacaaagtaatcaacgacgtagaaagtttgggcccggatctcctccccgaaactagccaattgctaaacgccattaaaaaacagcggactattaatttttctgctacgggatttcaaagggtgaaccggtaccttgaagtaattgttgcccgtcaaaaaaatagttaccaaacttctgacgtagcccaaactgaaaaacggtattatcagtttttactggataaattagcagaattagagcctgatgaagtactgctacgggatttagcgattcacttggcgaccgcggtcgaccgtttaaagaagggcattgtgattgataacccgtatacggatgaaatcaaaatgaacttaccgattgcttttgatgtggcaatccagttaggggaggcaatcgaaacccagtacccagttcaacttcacgacgcagaattagggtatttagccctccattttgaagccttttttgaacgttgccacctgcatgctccaattgaaacggtggtggtcagttctgctggggtcggagcatcgcaattgctggcgcaacggttggaggaacgtttcaataacagtttgaaagttacccggattttagacttggcaacggtgatgaagactaatttagcagaaaaaatggtggttagtacgattcccatttatggactgaaacaaccggtaatcttagttagcccgcttctaccccccgaggatatccaacaaatcaatcatgcaattattagcctaactaaaaacaatcattcaaattcattcttcaatttgttggatccgcagctaattcaaatcgattcagtgaaaaagagttacgtaacggtactcgaagaaattgtgggctcactcactaaacaaaacatcttggtaaataatcctaaaattttggaaatgctggtggaacgcgaaaagatggcgtcaaccgcgcttaatgcagttgcaattccccacattgcgcctaattacgtgcaaaaatcagccatcgcgctatggttagtgccgcaaggagtgcagtggttggggaacacggtgtacgtggttatctttttggccctcacgcgtgaacaggttgccgcaagtcgggaagtttataaaattttaaatcggatggtcgaaaacacagctttttgtcagcaattggctcaagtagcgacggcctccaaagcgatggaacatattcaaaaatttatacagaaagagggagattgagtaatggattcagatgtaaaatgcgcagcttttattgacgtaaaggtagcaccgcaaaaagaggcggcgttagcgactacggccgaactattagcaaaccagtggtcgattgatggtaaagaattgtatgccagctttgttaaccgggaggcggaaagttcgacaggattcggggatggaattgcgattccccatgcaaaggtttctgggttagaagctccggtagtgggaattttaacgtacgctgacccagttgagtgggcggcgattgatgaacaaccggtttcacttgcgattgcgttgatcgtacccactaaggcagatcaagttcatttgcggttgctttccaagttggctcgtaaattagttgatcatgattatgcagaaggacttcgtcggtccgcgcacgatgctgcacaacttaccaaacaggttcaacaagctttagcagaataaacgtttatggaaagaaggtagtaaaatgaaaaaaattgttggcgtaaccaagtgtccggtgggaattgcccatacgtacatggcggccgaaaagttaaaggcagcggccgaagcagctggatacgaggctaaggtcgaaacgcagggcgcttcgcgaaccgaaaatccgttaacccaggccgaaattgacgctgccgattacgtaatcttagcggttgacgtagcaattgacgggatggaacgatttaacgggaaaaaggttttattcagcaaaacttcggcggccattaaggattcggcagcgctagttgagaaagttaccaacgctccggtatactacgccggaaaaacttcggcagcctcaacgcaaactacggacaatgccaaggggcaaaatccagcaatcaaacagttgttaaacggggtttcgcacatgattccgttcgtagttgtcggcggattgttcatcgccctttcaattgctttaggtggccatccaactgccaatgccggaatggtggttactcccgggaccatttggagttcaatgaatcaaatcggaaccttaggcttcaccttaatgattccaattcttgcaggatttacagctcatgcaattgcggggcgggctgcgttagcccccgccatgattggtgccatcaccagatattttgggaaccaaggcgggaaccggattcttaggagccattctagttggttttgcagcgggatacttagttaaatggatgaactcctggccaatcccgaaaaacttgcggtccgtcatgccaatttttgtgattccgcttttaggtaccgcgataatttcggcagcgtttatttacctattgggtggtccaatttctgcgttgatgacgttactgcaaaacatgcttgatacgctatcggcgagcccgtcaacttcggtattacttggattgattttgggcgcgatggtagcgattgacatgggtggtccaattaacaaggtagccttcctgtttggggtagcatcaattaccgcagggaatcccatgattatgggtgctgtggcttgttcagtttcggttccaccactttcttcgggacttgcgaccttaattcgcccagatctaaacgtcaatgaagaagaacggtcggcgggaatttctgccatgttaatggcgttgattggcattacggaaggggctattccactggcaacgacccggccaggacaagtatttccgggaatcatcatcggttcagcagttgccggcgccaccgggatgatttttaagattacagacgcggttcctcatggcggctcaattgtcggtgtgcttggggcaactaataatttaggattgtttattatcgcaatcttaacgggtaccgcggtttccgttttgattattgctattttaaaaatcagagcgggcaaaaaggcggctaaacaactttcttaaaaattaattgaaaaagagagtgggtaaaaagtcggatagtttgcgagcattaactgaaaattgatcatgatgcctgaatttggcataatggtcaatttttggttaaggggaacaaactgacttttagtacacgctttagctttattgaaatcaaaacaccaaaacaacttttcaaggaccttttcatccttgaaaaggattttttagtttttttccaacctctttttgtattggaatagtatgtaattcaatggtggcacgcgtaattgcgagcttcggcgataatgcgttcttgatcgagggtgagtacttgccgatttcgcatcaagaactgtccgtcaaccatcgtatctgtgacgtcgttagcgttgacacactctaacagggtatttttccagttgccggaagggtaaaggtggggatgattaaggtcaattgcaattaagtcggctttataaccgggttgaattttacctaactgcccagcgtggtttaatgcggcggcgccaccttctaagagcattcgaaaaatttgagcagcgggcatgacgttaggttgccgtaatcgaaggccgtgggtagcgaccattagggagcgaaaaattttaatttcgttccaaaggcttaaaccaccgtgagcggcgccgtcggttcctaacccaacggaaatttgattttgaagtaactcgggagtactgggaactccttttccggcgttactaaacgggcaatgacaaagtttaacccggtattttttaatgagttccttttcgtggttagataggaagaggctatgggcacctaaaaaatggttactgagtaagtgacgcttagctaaccattcataagggcgtaacccggttcgttgaataatgttgagtatttcggtggggtattcgttcatgtgcgcggttaaaaaagtgtggtgtgtttgagcagcctcagcagtaaggtcaattaattcatcggaacaagcggtgagggcccgtagcgagtagtaaacttgtaaacgaccttggtgatggaattgctgatatagttgggtggtttgggcgacggcttcgcgggcgctcattttaattgacgctggtagctggggatcgtccatggtggaggtagtcaacgcgccacgcaaaccactacgagcgtaaacttctgcagcactttccatgtggtagctgccagcttctacaaaaccggtggttccgccagtgatcatttctaaagcagctaattctgcacttagtttcatctgggacgcggttagttgactttcgaaaggtagcataatccgggtccaaattactggtttagcatcaagtacgcgtccccgcaaaagttgctgtccagtatgtaagtggctgtcaattaatccgggaagataaaggcggtcggctccgtcgacaatctcacccgtgaatttaataggacagggaaaatcacccacctgttggatatgaccgtcatgaatcaaaatcgattgcttggtattaatttgtccagcttgttttaaaatggtggcatttttgattagaatatcagacatcgttaataagaacctcgctaaagtaatttggttaagcccaacgtgaaggagtcccataaacaagaacctaagaaagttccggtcataactagaattccaacgataacatatttccagccctggctaacaaaacgctgcaactggtcactaatggcgattccggcaaaggaacccacgatggtaaagggggctgcaaattcaatggcgtttgcactgctaattagccacgagtgaacgggcgaaaagggcgccgctcccaatagtcctaaaattgaacagtaggcaattagcggaagcttaaggggtaggtattttacgcaaagcaccgctaaaagcgtgatcacggtcaatgcaaagatgccgttaaggcttttttggaatgagataccgtaaccaatccaattggctaatccagtaccaatcccacatacaattaatagaaaagtccattctcgataacgcatgctttaacctcggttcaatttaagatgacgttgagtttgtaaacggaaaattttacaaagtaggtcgtaatacttttcggtcagggggagggcaagccacatggtgatgtaaattccggtaattccagcaattgtgttactagctgaagccattgtggtaattattgcggcgtgggcagggaaggcgttggctaaactagcacttgcacttgccatgaagattccggcgccaactccggaagccattccgagtgcttgagggctaaaccaaccggtactggcaattaaggaagccatgatgccaaagtaaattgctccaatcatgccgccaacgatgtaaagggctaagctgccgttactttcagcagattccgcaccgtacgcgttattaatcacggctaagtggtattcacggtttaaggagctacaagccccgatggtttcgcgatgtaggccaagtaacatcgcaatcggaagagccaaaattggaccaaggagactcccaaaaccgtgtagcaacagggcgggaccggcgtttaaaattaaatgaagattagctcccgcggtaatgccaagtttaacgatgaagggacagatcccaactaaaacaagttttccagcagccgtagtttcggcaggccggattaattttaaaacctgaggaccgagcataattcctaaaataattgcgtagaaaacggggaagaaaataatcactccgttgccaattttaagggtgacctcgccaatcccatcggcaattaacactagtatcaaactaattaggtaaattttcttttcatttttaaggcgctgccaaagggatgaataatcatcgacggatcgtttcattcaaagcactcctttctggatcttaactatgttttgagtttaacacgttataattagcaataaaagaacttttaacgttatttttgtttttatagttcgtgtttattggaaatgaaacgagctggcttcgaggctaagaaaacgcttgctttttaaagaggctcctgtatagtgggaagagactggtttttgccaatcaaattgttacccattttaatgaatagaatgtaaaatctttatttggtaaataaaaacccgtaattattagaaaaaaatctaataactacgggaatttgtggttcaaaaattaattaccttttaaatagcgataagtgatggtgtaggactggggttcgttagctgataaagtgatatcgccaaaaccgggatggttatgggtgtctggcagagtttgagcttccatagcgatccccatttgaggccgccccggtcccctagtaaagcttaaggtattgtcgagagcgttagcggtgtaaaccactagaccattacgtttagaataaatttcgagagcatctttactatctaagtcttgtagtttcgcgatgggagcggcgttttcgttaattttaaaaatgtcatcgaggcctttttctggggtgctctgcaaggcggcaatggcgtcttgtagctttaccggttgacggaaatcgtaggctgtatttgcggtggcaagaaactcccccgtggggaccttttgctgatcaacggctaaatactgtgcactagcaatcgtcaactggtggttcaatacatggtcacgattgcttaagttaaagtatgcatgacaagttgggttgaaaagcgttggttgatcagcagttccttgataagtaatgataacttggtcgtcgttagtgagtttaaacgtaatggcaacagcaatgtttcctggatagccgtcgtcgctttctttgatttgatgagtaaaggtgacggacaaaaagtcttcacccttttgcagatggtagtcccagaggtaatcaaagaaactgtggggaccgccgtggtgagtattattattttcgtttggtggtaaatgaaccgccccttttgctaacggcatggttccgtccttaatgcgtcccgcggttcgaccgattgccattccaatgtaaaaggggttatcgtaatactttttagtttggtcaaaactaagtacgagattttttcggccatcagcttgggggaccgaaaattcatttagaatggctcccatggtgagcaccccaacggaaacatcgtggtcattagttaagcgaattttttcgacctggtggccgcgaaattgatcgaacttaagtatatcaatgtgcatatttatgtacctccatgtttgaaaccgttatcattattcttaatcctaaaatttgtccggataaatgtcaatgattttaacgacgaatgcatagaattaaaaaagaatcggtattagagatttatcatttaaaaataagtgataacattttacttatcgtataataaatttgctgtagtagaggaggagcaatcatcgaaaaaaagtacgaactggttaaacaagatttaaaggaagaaattttatcggggagttattcaattaacgataaattgccaactgaatcagaattaatggaaaaatatgacgtgagtcgttatacaatccgacgcgcggttggcgatttagaaaatgatcactacatctaccgggtgcaaggcgggggaatgtttgtcgacgactggcagaaatacgtaaaccaaaaggtagaaaataaggtgattggcgtcatcaccacccacattgcggagtatatctttccgtacattattacgggcattgaccggttgatttcctcacgtggttattcaatcctcattagcaatacgcaaaatgatcctgctcgagaaagaaagagcgtccaaaaaatgatggatagtaatttatcaggtttgattgtcgagcccacccagagcgctttaggcaaccctaatcgtgatttgtatgagaaaattaaagagtcgaaactgcctaccgtgtttattaacgcgcattaccctgaattagatttcccatacgcggaaatggctgatacccgggcagagaaaatcattactaataaattgattagtatgggacatcaaaagattttaggcgtttttaaagttgatgaccaacaaggcgttcaccgaatgaatggttttattaaggcctataaggaacaccaagacttagtttatcaaagtgaaattgtgatgtaccaaacttcggataacatgcggtcggtatttacgaaaatcgaacaaattctgagccgctcgccaaatgaacggccaactgcgattatttgttaccatgaccaaattgccattcaggtgatggcactagtgcggtccttaggcttacgtatgccggatgacatttccatctttggctttgataactataagctatcaaagtatatgtctccacagctaagttctgtagaacacccgaaagaaaaattagggcgggacgcagccaagatgatttttgacatgattgatggaaagacggatattcaaaataaaatttacgaacctgaaattatctaccgagagtcaattaaggaactatcgtaacagtcaattgattagataaatttagaggtgtagtaccaatctttggtattacacctcttttttagtgtccataagataaatttatgctaataaattttaaaaattcatgttgacttgtccgtataaatattctaagatgaaagcaagttaatgaatacgttttcaaagaaatggaaacggtttaaggaggaatagcatgggcaaggaaaagaaaattccaagtggatttatttacttcttcggttcatttggaggaattttgtttggttatgacattggggtaatgaccggggcactcccgttcttacaacacgattggaatttatatggtgacgccggtgtaatcggttggattactagtgcagtaatgtttggagctatttttggaggcgctttagctggtaacttatcagatcggctaggtcggcggaaaatgattttgatttcatcattaattttcgtaattggttcgctattatccgcattatcgccgcacgatggtcaaatttatctgataattgttcggatcttcttaggactagcggtaggggcagcctcagcgctggtaccagcgtacatgtctgagatggctcctgctcgtttgcggggccgcctatccggaatcaaccaaaccatgattgtttctgggatgctgttatcttacattgttgatttcttacttaaagatttgcctgaaacaatggcatggcgtttgatgcttggattggctgcggttcccgcaatcatcctttactttggagttttgcgtttaccagaatcacctcgtttcttagttaagagcaacgatgttgaaggtgcacggcggacgctaacttacatccgtaacgaagcggaagtagaacctgaattgaaaacgattcaagagactgccgcagaagaagcaagtgccaacgaaaaatcttcctttgcacaattgctaaatggtaaatatcgttacctagtaattgccggagtcggggtggctgctttccaacaattccaaggtgctaacgcgattttctattacattccattgattgttgaaaaagctaccgggaatgctgctagttcagcattaatgtggccgattattcaaggggttatcttggtactgggctcgttagtattcttatggattgccgataaattcaaacgacggacacttttgacaatgggtggcaccattatgggactatcctttatcctcccagcaatcttaaacatgtttattaaagatatgaatccgatgatgatcgtagtcttcttatgtatttacgtagcgttttactcctttacctgggcaccacttacttgggtaattgttggggaaatcttcccgttagccattcgtggtaaagcatccggggttgcatcatcattcaactggatcggttcattcttagttggtttattattcccaattatgacggcaaacatgccgcaagaagcagtgtttgcaatcttcggaatcatttgtttattaggtgtattgtttatcagaactcgggtacccgaaacaaagggtcacagtctagaagaaattgaagaacagggacttagaaaataagaatttggaggttttgaaaatgaatattgtagaaatatcaaaccaaattgaacaaggaaacgtcgcccttggaattgagttaggttctacccggattaaaacggttttgatcactaacgactataagacgattgcttctggtagttttgtttgggaaaaccaatacaaagacaacatttggacgtattcgcttgaagacgtttggaagggaattcaaaccagttattcaaaaatggcggccgaagtcaaaagtaagtatcacaaaccgttgaccaaaattaagtcgattggaattagtgcaatgatgcacggctacttggcttttgaccaaagcggtgacctattagtgccgttccggacgtggcggaataacatcaccgaagagtcggcagccaaactaactgaagcctttaacttcaacatccctcagcgttggacaattgctcacctttatcaagctatcttaaatggtgaagaccacgttgaaaacttggattttgttactaccttggccggttacgtacactggaaattatcaggtgaaaaggtattaggagttggggatgcttctggagtatttccaattgatgaacagacggggaattattcagaaagtatgttagcaacttttgctaacttgcctgaagttaaaccatttagctgggacatcaagaacgtcttgccaagcgttaaaaaggccggcgaaaacgcgggggaattatccgcgcagggcgctaagctactagatattacgggaaatttgcaagcaggtagtttgatggcaccaccagaaggggatgctggaaccggaatggtcgggactaatagtgtccgcaaacggaccggaaatatttcggttggtacttctgctttctcaatggttgtattagaaaaaccattgaaatcagtgcaccggaatattgacgtagtgatgacgccagacggggctgcagtagccatggttcacgttaacaactgttcctcagatattaacgcctgggcccaaatttttaacgaatttgcgactcgactagggattaatttgacgccggataagttgtacgaagcactgttcttagaggcggctaaggcggatcacgaccttggcggattggtcaactacagttaccagtctggtgaaaatatcaccaatatcaaggcgggccggccattgtttgtccggaagccagacagccactttaacttgccgaacttcatgcaaacccagctttattctgcatttgcgccactaaaaatcggcatggatattttgagcaaggaagaaaatattaaaaccgacgtaatgattgcacaaggcgggttgttccggacagccgtaattgcacagcaagttctatcagatgccctcaacaccccaattaccgtaatgagtaatgctggtgaaggcggaccttggggaatggcaattttggcaatgtacgctgccgataatcaaggacaaagcttaagtgattatttagactacaacgtctttaataatccagaaagcatgacgcttagtcctgagccagagggagtggctgcttacaatgaatttactaagcactacgaagctggtttgccagttgaagcacgcgccggtgaagtaatttaggaaggggagatttgatgctagaaaaacttaaacaggaagtctacgaagctaatatgcagctgcccaagctggatttagttacgtttacctgggggaacgtctccgggatcgaccgcgaaaagggattatttgttattaaaccttcgggagtttcgtacgaagaaatgaaacccgaagatatggtggtagttaatttaaagggtgaggttgttgaaggggatatgaatccttctagcgatacaccgacccacaccgttttatataacgaatttccggacgttggaggaatcgtgcatacccattctccatgggcggtatcgtttgcagcggccgaaattgacgtgccagctttaagtacgacccatgctgacacattctacggtgacgtaccggtaactccggccttaactaaacaagagattgaagaagcatacgaagaaaatactggtaaggtaatcgttcgagaatttaaggaacggaatttggaccacaatgcggttcctgctgtattggttagccaacacggaccatttacctggggtgccacaccggacaaagcggtttacaacgctaaagtattggaagtcgctgctgaaatcgactatcacgctttgcagatgacccggcggaatatcgaagttcctcaatacttattagataagcactactatcgtaaacacgggaagaatgcttattatgggcaaaataatgccaaatctaaagaacacgcacaaagaaaataaaaatatttttaattagaaaaggagcgctttaacatgaaaaaaatgcaagattatgaattttggtttattacaggtagtcaattcctatatggtgaagaaacccttcgttcagtagaaaaggacgctcgcaaaatcgttgataagttaaatgaatccaagaacttaccttatccagttaaattcaagttggtagcaactactgctgaaaacatcactcaagtaatgaaggatgctaactataacgacaaagttgccggggtaattacctggatgcataccttctcaccagctaaaaactggatccgcggtactaagttattgcaaaaaccattgcttcacttagcaacccaattcttgaaccacattccatatgacaccattgattttgactacatgaacttaaatcaatctgctcatggtgaccgtgaatatgcctttattaatgcacgcttgcgtaagaacaacaagatcatcactggttactggggtgatgaagacattcaaaaacaaatcgctaaatggatggacgcagccgttggctataatgaatcatttggtatcaaggtagtaacctttgctgacaagatgcgtaacgtagcggttactgatggtgacaagattgaagcacaaattaaatttggctggaccgtcgattactggggagttgcggacttagttgaagaagttaacgccgttgctgaagacgacatcaacaataagtacgaaaaaatgaagaaggaatacaacttcgttgaaggagaaaattcttcagaaaaattcgaacacaatactaagtaccaaattcgtgaatactttgcattgaagaaattcatggacgatcgcggatacaccgccttcacaactaactttgaagacttagctggtttggaacaacttccaggattggctgttcaaatgttgatggctgaaggctatggcttcgctggtgaaggggactggaagaccgctgctttggatcgcttaatgaagatcattgcgcataaccaacatactgccttcatggaagattacacccttgaccttcgtaagggacacgaagcaatccttggctcacacatgctagaagttgacccaacgttagctagtgacactccacgggtcgaagttcacccacttgacattggtggcaaggatgaccccgcacgctttgtcttcactggtatggaaggcgacgcggttgacgttacgatggctgactacggtgatgaattcaagctcatgtcttacgatgttcaaggcaacaagcctgaaaaagaaacaccacatcttccagttgctaaacaactctggactccaaaacaaggttggaagaagggtgctgaaggctggctcacacttggtggaggccatcataccgtactttccttcaacgtggatgctgaacaattacaagacctcagcaacatgtttggattgacatacgttaatattaaataattgtttactaagataaatatttctaaaagaactgatcaatatgattgatcggttcttttattatgattcgataaagggttaaaaagaagggcagaaaaataagttaggaaaagaagtcaacattacgtgattaggagcttaattaaagacttactttttgtgaatgtgaatccattgttttattttttctaataatatgagtatcgtaactagacaaaaatttgaattgaattagatttaatatattgttatctcaacgttttttcgttatatttaaaatttttaataatatttttataattaaatctaaataaattaattggattttaattatgcaaccgctttacttctttgagcaaagtgtgcaataatatacgtgtagttaaataaatcacaaggaagtgtctttatgcaaattgctgttattaaagaacaaaaagaaggggaaggtcgtgtagcggccacgccggaaaatgttcaaaagatggttgatgccggtaatgaagtcttagttgaaaaggatgccggaatcggtgcaggcttttctaacgaagaatttgaaaaagctggtgggaagatcgtttctcatgaagatgcatggaaagcagaattgtgcattaaggttaaagaacctgatgctgaagaataccaatactttgataaaggtaaaattatttggggattccaacaccttgcatcttccaaaccaactgttgaagcaatgatgaaggccggagttactgcaatcggtggtgaaaccatcgttaagggtggtaaattagagttgttagcaccaatgagccaaattgcgggacgtcgttcagtaatcatgggagcttattaccttgaagcacaacatcaaggggaaggtattttagtttctggaattccaggagttatccctgctggacatgtagtgattttcggtggtggtaacgccgcgacaggcgctgcagacactgctttaggtttaggatgctcagtagtaattattgagttaaacgacgaccggattgctcaattggaagaacaatataagggtaaagacgttcgcgtagttaaatcaaacgaagaaaatcttgcaaaagaaattaaagatgctgatatttttgtatccacaattttaatcccaggttccaagccaccgaagttggttaaagaatacatggtaaaaagcatgaagaagggctctgtaatcgctgatattgcaatcgatcaaggtggaacagtagaaaccattgatcacccaaccactattgatgaccctgtcttcattaaggatggagtaatccactacgctgtaccaaaccaacctggtgccgttccacggactgctacgatggcgttagcagctggtaaccttgattatattttggaaattgccgataagggaattgaaggagcaatcaaggaagataaagctttagcatctggggtcaacctctacgaaggtaaggtaactaacaagggtcttgcagattcattagaccttccttacactgaactagatgtataaataggcgttcgaacttttaaatttgcgtttaaattatgaggtgaaaatcatgaaaaataatgaaccaagaaatgaagtagttgctcaaacctacgatttattaaacttagatcaaattgaagaagcgcgtaaagtaattggtaaatacgcacgtcggacgccattagttcagtcaatgtttttaagtaacaatgttgctcatgcggatgtatatctaaaacttgaaaatatgcaacttactggttcattcaaattcagaggagctaataataaaattaaccacttgtctgatgaagaaaaaaagcatggagtaattacagcttcagctgggaaccatgcgcaaggagttgctttaactggtaaactttctggaattgacaccacggttgtaatgccggacgaagctcctcaaatgaagcgggatgcaactcgtggatacggggcggaagttgatattcacggagcaactttcgatgatgctcacgactggatgcatgaaagagctgaaaaagaaggaaagactatcgttgatccatttaacgattccctcgtttgtgctggtcaaggaaccatcggtctagaaattcttgaagacttggttgatgtagaaaccatcattgtaccagttggtggtggtgggttgatttcaggaattgccacagcagttaagtcaatcaacccttccattcacgtagttggggttcaatccgaaaacgttcacggaatgaaagcttcagtagatgctggtaagattgtaaagcatcatgatgactttacgcttgctgacggcactgatgtagctgttcctggggacatcacttacggaattgtttctaagttagttgacgaaattgttctagttagtgaagaagaaatttctaaggcaatgaaggacttgatgcaacgcaccaagattgttgcagaaggtgctggtgcattaccaactgctgcacttgaagcaggcaagattgataagaaatggatcgaaggtaagaaagtcgttgccctagtatccggtggtaacgttgaccttcaacgtgtttcacaaattattgatcacttcttctccccagttgatacacacaaagttgggattggatagaatgattaggcaagcaattgcagattgaaaatctaagggatgctgcatgaattgcagcgtcccttttttaaaataattaaaattggaacaatgaggagtgattatcaatgaacgataatagtacatctctaaaaaagacaattggttttttcccggcgttagcaacggttatgggaacggttattggtaccggcgtattctttaaggcagccgcggtaaccgaatatactgggacggtctcaatggcccttttcgcgtggctattgggtggactaattagtatttgcgctgggttgactggtgctgagctagcggcgatgttccctgaaactggggggctgactcgttacattgaacatacttatggtcacttttggggatttttagcaggttgggcacaagcaattatttattttcctgctaacgtagcggccattgcgattgcgtttggaacccagttcacgaacttatttaatctttcgcaaacatggatagttcctgtagcaatcattactgcactctcattattgttagttaactgcattagcgcaaaatttggtggttgggtaacatcggtagctttagtagttaagctgatcccgttagccgtaattgttttgttaggatttttccatagtagttcggttaacttctcactattcccagttgtagctggaccacatcgcgcattttggacagctttagggaatggattattagcgaccatgtttgcttatgatggatggattcacgttggtaacattgccggtgaaatgaaaaatccgcgtaaggatctacctaaagcgattgctcttggcatcggactgattatggtggtttacctgttagttaatgccgtattcctctacattgctccagttaatcacgttgctggaaatttgaacattgcttctgacgttgcaaaggttatttttggcggtatcggcggtaaatttgttacaatcggtatcttgatttcagtgtatggtggactcaatggatacactatgacaggaatgagaattccttacgtaatgggtaaagaacataaactaccattcggagatgtttttgctaaattaaatgaagcgggggtgccttgggcagctggagttatccaatacttgattgcttgcttaatgatgctttctggtcaatttgatgcaattaccaatatgctaattttcgtaatttggttcttctactgcatggcttttgtggcggtatttgttttgagaaaacggacaccaaatgcaaatcgaccgtataaggtcccactttatccagtaattccggcaattgctcttgtaggaggagttttcattttggttaacacgctcttcacacaatttactacgacagcgattgggattgtagctaccgcagtaggggttattttctactattatttaaaaaataagtatccagaaaattttaagagtgaaaaataattttgtgtttgaaatggcagaaaactatcccagtcagggaggatttctgccttttttagtagacaatggttaggcagtagcgctacttgataagaataggtggaagcgctattattaaacatatgataattgattcacaaaagttaggtattagtggttgttaaagaaagggattgaattggatggcacaaaatgtttctaagaaagattatggtggtaatggtaagagcaagtacgttccttacgttactaaaaaggggcatggcggaagtattgctattttgattatgggaattattttagccgtaatctttggagcgtcaacagcatactcggggatgaaagctggactaacggtagcagctgggattcctgggtcaatcattggttcgggtttagtaagtctttttgctaagaaaaaggggattcttggcaaaaatattttgcaaggaatgtctagtggtggagaagccgttgcgagtgggatgatttacgtccttccagcaattatcttgattggcggacacgttaattttttcactggggtaatggttggtgctttggcagttatgtttgccattgggagcgcatcattagttcaaaattatctgattgttgaggaacatgggcgccttgcttacccagaatccatggcgattaccgaagcgttagtcgcttcagaaagcggtggagattcattaaaattcctaggggtaggttttggaatcgggggcataattactttatttacttctcaagtttttggttgggtaaatagcatgatcactttcaccgggaactcgttttatcgatggaagatgtcgacagaagttaatcctatgctagccggaattggttttgtggttggtttagaagttgcaatgaccatgtttgcagggtcaatcctgtcaaactttgccgtggtgcctttagttagttactttgcacaaatggcaggaagcggtgcacacgtttggaatgatgccgcgctgagcatctcccaaatgagcgttgacgatgttgcaggctcgtatgttaagtatattggcgcaggaatgatgctttgtggcggaattattggtgcagttaaattgataccagtaatttggacttcaatcaaaaaagtacttaatgcgcggaatagtactactgaagataaaaatgctttgggattaattgccttactagcatcggtaatcgctatttttattgctggctttatcatttcgggatcggttatcgttgccttgcttggcggggtcttaacgctaattttatcgttgttgtttgtaattgtttctgcacgactagccgggacgattggttgttctaacgaaccagtgtcagggatgaccattgcatcgctagtaatcatgactttggccttcgtattgatgggttggactaccaaaaattacacagaaattttgcttttgtttggggtatttatcgttactacggtttcagtcggtggcggatatatgcaaacccaaaaagttaactacatgattggcggctcaaacaaggaaatgatgaagtactacatgattgctggctttgtgggggtgctcaccgtaattggaactacggtacttttggaaccacaattgcggatcacgggttctaacccgccatttggactgccacaagctaacttaattgcaactttaacgtctggcatcatgtctggagatttaccatggattatgatcattgtggggattgtgatggccttagttttctggatgctagacttaccaattatgacggttgcgttaggtttttacttaccaatttcaactacttcaattattttagtaggggcattattaaaacttttgatcaataagactactaaagacaaagagttacgtgacaaacgggtacaaagcggtgtcagcctttcttctggactaattgccggtggttcaatcattggccttgttggaattattttccacgttaccggattgctgggtaatagtgcaccaagtggctttttagcaagcaacgcaatgggattaatattactagcagctatggcgggagcgattataattccgttatatataattaaaaaatctgaaaatcaagggaaggctgaagaacgtgagtaagtcacctaaactgacggatgctgatctaaaagaattagtttttaagaagaatccgcgggttaattataaagttgaaggtaaacaggtgaccattattcgtgctcaaaaccattggattcaacaatttttacgaaagttgcattttaaaattccagagtttacttacctagatttagatgaatacggtagttttgtatttcaacaaattgatgggcaacgcagcgcgtatgagattggtcagaatttaggcgaacagttcgaggaagccaatgactatttgtatagtcgattattattgtatttgaagcagctagaggttaacgaacaaattattgaacgagtttaaagaaatttaaaaggaggatttatcatgacggatagaattgaaatgtcagcatgtacttcagtaatggttggaaaaaaggcttcgctcgatggtgcaacctacatttccagaaatgaagaccggttagtagctattcatccaaaacgcttcttggttcaaccagccgtctccggacgacaagaaatttataaatcaccatataacggattaactgtaccgttgcctgaaagtggctatcggtatacttcaacacctaatgctgatgagagcgaagggcctaatgaagaagacggttttaacgaaaaaacgttggtgaaagtgccacggaaagtgtttacgctaacgaacgagttttagcgtacgatccatttgttaaaaatggtttagcagaagattccatgactacgttagtattaccattcattaattctgctcgggatggggttcgttacctaggcgaattggtgaaaaagtacggttcagcagaaggtaatggcgtccaatttaatgatgctgacgaagtgtggtacatggagattgttacgggccatcaatgggttgccgttcggattccggacgattgctatgccgtggctgctaaccaaatcgcgattgaagacattgacttcaatgatcctgacaattacatgtgggcggatggtattcaagaatttgtcgaaaagcatggtttgaatcctgacgaagatcgctggaatttccggcacatctttggaacggatacggaaaaggatcatcattacaatactcctcgggtttggtttgctcaacgttacttaaactcggagattgaacaagatcctgaatcaccagatctaccgtttattcggaaagctagtcgaaagatttcggttgaagatattcaatatattctgaagtcgcactatgacgaaactaagtacgacccattaggaagtggtagcgaacacgatcggaagacgtaccgggcaatttccttatctcgaacagccaattcacatattttgcaaatgcggaatagtcatgaaaatgaagcggctggagttcagtggattggctttggcgtaccaagtttttgcccacacgtaccattctttaccaacgctaatgatactgacgtttcctaccgggaattaccggaagagatgtcattagatagtgcatactggttgtatgaaactttagcaatggtagtggaatctcactacgctgaatttattcaggacgatttggattaccaaaaagagttgtcgcaatgggcacggaccaagattgaagaagttgaccaagtagctaagaagatgtcgggaaaagaattgacaaaatatcttactgaacaaaatcaccttattgcgcaacattataataaagaaaccaagaaacttttagctaagttaaccaagcagggtgcggaattatcgaagctaacctttaagatggatccaaatttgtgattcaaaagataggcttggtgttatgtagtcgtctaaaagtgttaaggggcggttgaataaaactttcaactaatttttcttaataattaaagtggccgttaggattttgataatcctgacgaccgctttttgttaatcaatataaatcatcgcgattcttaatcaattcatttttatagttaatgggggtagtatttacatattttttaaacaatcggtttagggaagaaggatttttataaccaattcgcaaggaaatttggtcaagcgataggttagtttgaaataaaagttcttgggctgcatatagacggcgttgttcaattaattctttaaacgtttgcccagtcgctgctttgatcttattactgagataattcatgttgtatccaaaatgcttacttgtatattgcaaattagtggttgaataatgctgttcgatgtactttaaaattgccaataattcagcattattgtctgccgcaaagtttagatggtgatggctaactaacggtggtaattgcgtaatcaaggttgaaaagagcaattttagcacttggttattatttttatgggcggattcaaaggctacgaataataagtccataatcagactacgtgacaatgattgtgcaggtaaatcgaaaatcatgaaattatggttggtagtttttaagttacaattttgcaaaaagtccgttacggcgttggattgaccagaaagtaagtccaatattttagtgatagttagagagttttttaacaaaatgttaatgatgacgtcattttccccagtatagccaattttttgaacagtattcttatccattaaaagtagttgaccttctgtaaactcaaattgctcgttatttagcgattgaatacaactacctgaatacatgtagttaagttcgatgaaatcatgagtatgcgcgggaacgtaagaaaaacgatttcctttaacaatggttaaatcgccatgtttaaaaaaattgtattttggcattttagggatggggctttccttaaaattgagcttcatataattgtaattagcgtgattttttcgctgagtgttctctacataatttagactacgtatttttttatccaaggtaataaaattcatcattagctgctcctttttaatggtcccacctgtagttttgcaaggattcgggtgaactggagatattgtagcacttattttaagcgcttacaatgaggatagttaaggaggagagatttatgcaaaatcaaagtgataatttagtgaaaaaataccgtcctctagctattgcagctggaatcggctcaattttaggttcggggatcattgttggattatcagcaacaattacggtgtggcaacaggggttagcattatctaacacccaagttggggtgatttcaggagcattaacttttgcaattgcaattggctcgttagttgccggatggttaaccaaaaattggggattaactcgttcatttaactggttaaatttaggctatgcggtaggagcactaatttgtgtgttagctaacagctatgactttttattaacaggagtgattattgcgggattagcttctggagcggatttaccagttagcttaacgattatttctcatgatgttcctgatgacaaagcaacggctcggttagtgtccttcacccaagttttttggcaaattggggtgtttttctcttatggttgtgcctttgtagtttctaaaatgactggggcaactggggcacgaattgtttttacgattttagcagtatgtgctgccatcacttttatttggcgcactttttctggtcgttttaaagaatttcatcgtgaagccaatcaacggattgaccaaatgcagtctcaaagaacttctgaatctggttcgctatttaaaattttgcgccaaaatcaccagtatgggttattctttatttggatcatgattttttattgttgctggaatttgttagcgaatacatttggacaatttcaaacttttactttggtacaagcacacgtgagccaaagttttgctacaggagcaggattagtattaaatgtagtggctttaattgcgtcaatatcatttgcctcagtagcaggtagccggtaccgtaacaaattttttgtggtaggttcagttatcgagctactagccatgctaggtttagcattaagcagccatgcattgtggccaattgttattgccattggtttttataacctaggtaataacattgctggcgaagctatgtataaggtttggacccaagagtcattcccaattgatagccgggcttcagttcaaggttttattagtggcttttcccgtttcttatgtgggatttttgcattcattacccctactttagttttaccaagccacatccgaatgactatgtttgggttcgctggaattgttgccgtatgtctaattgcgggattggtaatgattcgattacaaaaaaggtaccagattaacgttgaggagtgagtggcgatggcatttacatttcaaattaatgatgatgtagaatttaatcatgacaaacagttactaaaaaaagcagatgacaacattccggaattagcaaaacgagtagtaactccggtgcaggtagttgaaacggtgatcgataaaaatttactagataatgttggaacaaaaaaagtggctgatactacacagcttagtcaaatgaaatttggccgggatgatcggttgattttagattttggcaatcattacgttgggcactttacaattcgaattaaatcagtcggatcaccaatggatgcgcccttaacgcttaaattgaaattcgccgagctgcctactgagttaaaccaagatagtcaagattatcaaggctggttaagccgttcatggatgcaagaagaaactgttcatttggacgaattgcctgccaacttgtgcttaccaagacgttacagttttcgttatgttgaaattaaagtggtggatacttctcctaagtggcaagttagtttctttgaaccagccttaattgcagaaagtgcggcacaaggagcgccaatcccattttatactgatgataaacttttacaaaaaattgatcaggtggggctgaagacgcttgcggactgtatgcaagacgtttttgaagacggacctaaacgagatcgacggctttggatcggggacttacgcttacaagctttagcggattatcaaacctatgacaaccaaaccttaattaagagatgtttatatttatttggtgcattggcagccaaagatgggcgaattcctgccaacgtatttgttaaaccaacttatacgccagatgacacattcttgctcgactacagtttgttttttgttagtatcttagatgattattttcaacacacggatgattacacagtacttgaagacttatatccagtggcgaaaaagcaaattgattacgttatgaaaaatatggttcagagtaatggcaaaattgtctttgatgaggattatccagtttttgtagattggtctaatgaatttaataaagatacggctggagttgccattataatatacgctttgaaacagtttatccatttatcacggcttcaaaagttggacacgattgattactaccaaaaagaattggcccaaattacaaattatgccaagcaaaacctctataacgaagaaagaggattatttatttctggtcctgatcatgaaattaacattgctagtcaagtttggatggttttagctcaagtaatgactccggaagaaaatcaccaattaatgagcaacgcagttaaaaaactattcccaattaaagggattgcaactccgtatatgtatcatcacgtaacccaagcactttttgaagcaggattgttggatgcgggaattcaactattgaaagattactgggggaagatgattgaattaggtgccgacacgttttgggaagcatttgatcccaatgatccaagttactccccatatggtagtgcaatggttaatagctattgccatgcttggagttgtacaccagtgtacttaatgagaaagtatttaagttagataactaaaatgagaatacaaaaagcgtttagaacccttaacgatgatgtgttgctcctccaaaaaattaaacttttttgggggccactacatgaagagttcaaacgctttttttatatctaaatcagttcggtgacatttttgtccatagtaatttttaaaccaaggattgggtcatctggattctgcatggacagatcttggcgattaagcacgtgaggcgtaaaaattcctaattgtaaatcttgaggacgaaagtattttttttcggcaaaggcgtaaagaaaatggtctttcgcggtaaagtaccagttggtttgttttaaggtggggagggcgcgagttccgtatatgccgtctccgtaagttgctaaccactttcctaattggcgaatcagtttcaaggcaggggttggtaaagtgccatcgggtttagggccaatacctaagatgacgttcccacctagtgaaacaatctttacaagataatgtaagatttctggaaatgttttgtaaacgtcattaggaacgtaaccccagtttttggctaagggaaggttactttcccaaaccttatgcggaattacatccggaattttgcgctcaggagttacgtaatcttcatatttaccaccgatggttcggtcaacgactaggatttgtggctgggtttgtttgatttgggagacaatcctgtccatatctaaaaattcatggtgttcgctatttacccaaccaccgtctaaccagaggatatcgattttgccgtaatttcgggtgatttccaataattgttttttaacaaagtcgttaaatttcttccacagttgcggattagaaaggggatcatatgaggcataacgtccgcgaaggtcggatccaggtgtccaataataagggcaatgccaatcagctttagaataataggcacctaccgcaacgttatgggcagtcaagcttttggcaaattcgtgaaataagtccttcccagtgtaatgagttacgttaaaatcagactgctgggtagcgtacatattgaaaccgtcatggtgtttagtggtaaagattgcgtaacgaaagccagccttttgaatttcagtagcccatttttcgggatcaaatttagctgggttaaaagctttggctaagttccaataatcatggcgaagggtggtaaggtcttttctccaaggctttttgcgagcccaggtatcttctttcgagagttgccatgattcgacgattccagctgctgaataaagtccccaatgaaagatgaccccaattttctggtcttgaaaccagcgaagttgttgcttttgggaattagtaagcgaagcgtattcttcaacagcggttttttggttttcaacgatatcctgacgaatttttttcatttcatataacctacattaaatttttttgctacggttgctagcaataacgaatggtaaatacaagaaaatatctaaaataaataaaaatgcggatagtaaggtggcaggtaagtctcctgcagtggttacccaagcagttaatattggcggtaacgtccatggtggaattaccacgcttttagcaacaaggcctaaggcagttaagggataggcaattgctaaattaatgataggtacaaataaaaacggaactgcgaaaaagggattcattacgacgggcattccaaacataattggctcagaaatattaaagaaactaggcagcagtccaagtttagcaacgttgcggtagtcttttcgcttagaaccccagaaaatggcgattaagaaaggcaaaattgccccggttcctcccaataatgtatacatgccaatccaagggttagtaacaatgttaggaacggcatggccagcgttaaatgcgtcgatattttgttgaatggcaactaacatcgaaggagaggttacggaagaaacaatgttttgcccatgtaatccaaagaaccataagatttgggttaaaatttgaactacaaagagacctagtggagattccaaagcaacttgtaaaggcaaggagattacgtcggtaattaattgtggtacgttttgccccgcaatttgagtataggtaaaagttagaatggcaaataagataattactaatgattcggggattaaagtgttgaaagattgagcaactgcgggaggtactgaatctggcatcttaatttgaaacttctttttactagaaatccaaactagtagctcggtacttaatagagccgcgataattcctacaaacattcctccagaagaagttaacgtttgggcataaataccagcgacttggacgggcttagtggcccccacgggaataacgtcattgtatagaggaaacatgattaaagtagttgctaaactcaagattccggcatgaagcgggttaacttctttagaatcaattcggccgttagcaatgtaaaaattagtgagtcggtaaccaatcaaaaatgaaactagaatggtcataattcccatagttccttggtttaccatggtaccaatgtctactaacttagtcgcataggggaaagcttttacgacagttgcgttagtaaaaactaacgagttaagtaaaatgaaaagcgaattaaccataatgattggcataatatcaataaaggcatcccggatggcaactaagtggcgtgattcggacactttagtagctacggggattaaccatttggtaatgtatttggtaagcacgggctgcacctcttttcaaaaatagtgaaaaaaataaatgtgaatcgattcaagagtagtataatggattaaaatatttttgcaagcgctttctttaacagaatcggagggattcacgtgacggtaataatgggatatttacatggaagacaaaattggaaaattaaacaaattcctggagaaaagttaacacatataaactatgcgtttgcgaaaatcgaggggcttaatttagtggataaaggggcccactttaaacaaattgcaacaataaagcaacattttccaaatttaaaggttaacattagcattggtggatggggcgcagaaggtttttcagatgccgttttaaacgcagatagccgaaataaatttgcaaccaatataattaattttatacagcaatatggcatagatggagttgactttgattgggaatatcctggttctgcattaggaggaattaaatctcgcactcaagatgcagaaaatttttatgcctttttaaaggtgttgcgagaaaaattggcaagttgtagtgatgaatatgaaatctctgctgcaatagcgggagatcccagtttattaactagtttgataaacggcgaaaaactcagcatagcagagtacctagattaccttaacgtaatgacctatgatttacggggaagttggactaacattacgggccaccaaactaacctatttccttacgatgccatagaaggtgagcttagtatcgataccacggttaagtatctaatcgctaagcaagttccaacagataaaatagtaattggcagtgcagcttacagccgcgattggcgagaagtggaccaacaagccccatccccagtaggggcgcttgctaaagaaaaggggacccaaactactccttaccaaaaaattagtcaattaattgctcaaaaaccacaatgctatttttgggatgaaaaagcaaaagcgccatattactttgatgaacaggtattcaggtcctttgatgacgaaaagtctatggaaagtaaagttaagtatgttcaacaacagcgactaggagggctgatgttatgggaactatccttggatccgcaaaatcaactaatttcagctgctaccaatgctcttgataaataaaattttgaattttataacagtaaaaaagttggagaaatcaatccccaactttttttgttggaaggtacttaacggcgtggtgaacaaaatattgttatcaatgcaacaatattgataagttacattaggtttgccagccgttgagggtgggacgggaactttgcgggtatggcagttattgggacctcaggcatggcaatcggtggaacactagggagggcttctttatagttagctccgcaggaacggtaatcagacagcaggccaagtttaataaagagggcttgttggtaagctattttggcgttccattctagagtttctagaatacgagcagcaacgtgcaaatcggtcgtggtgataactacgccgtgactatttaataaaaagacgttttccatagccttgtctccaattgcttgaaggtttttgaatacgatatccgctaaagcttggctagtggcaggggcgaagggtaatactttaatttgtcctaattcccgcgttgcttcggtcacgttaggcatgtctaaaccagcagtagcccaaaacatcgattcttcggcgtgggaatggtagacacatcgaattcctgggtgagctttgtaagcttctttatgcatgttaatttcccgagtaacatctccaactccgtcaattttttcaccagtttcttcatcaatcaccaaaatttgtgcagcatgaagttcggaataataggtttctgacataaaggtgggagtcatgataatataagggtgcattttttggtcaaaaactttgatcgacatgttgccacctgctacgttggtatttttacgatcaaacattttttgtacggtgtgggctaagtcaatgcgttcctcttcaaacatcattttcataattaaattcctcctaaatttcaaagtgttaaatcactctatggcctcattatactgacaactgtattgaaaattagggctggctttgatttatgaaatgccttcaaaataattgaggaatttcattcagaatgcttcaaaagtcttcattttcaataaaataatgaaaatcgaggaggaaagcaatgtttaagaacgaacgttttttgactattttagatttgctacaaaaaaagaaggttatgcgggtcaaagatttacaaaaagaactttttgttagtgattcgacaattcggcgagacctaattgcgttggaaaagatgggtaaggtcacccgaaaatttgggcgggtcgaattagttaaggcagataatattgagttgtcctttttatttcgccaacaagaaaatagtgaatcaaaaaaatacatcgctgaaattgcaagtacgtttttaggggacaacgaggccatttttgtggattccagcagcactacgtcctttttagctcctttttttgaaggattaaccaacttagtggtagttaccaatagcctaaaattggcaatcaaattggatgaaattccggcggtaaaaactttcattgctggcggacgactccgctcagggacgggttcaattttgggcgatatttcgctagatttctttagtgattttcgagcagacttagtgtttttatcgtgttcttcaattaatgctaatgacgtttatatgtctagtgaagaacaatcgggagttaaacgaagaatgatggaaaatgctgaaaagaaaattttgctatgtgatcattcaaagtttaacgtgaaaggatattaccggttgtgcgatgtaaatgactttgatgttattatcatggatcaacagccaccggaagaaattatggcggtttggtcccataaaaacgtggaggttttgtattaaaaatttaaataattttgtagccgggatgttcccggtttttttgttaaatgaatgaaaatgatgaatgcttttgaacaaaaagatgcaaaaaatatgaagaactttcagaagacgtgaaacaccttccaaacacttatggaagcggttactatgaggacgaaaagaaattatgtatttcttttaacaaacagtttaaatactttaggaggttaggacatgttaaaaattaattatcccaaaattggaattcgtccaactatcgacggacggcgtaaggggattcgggaatcgttagagacgcaaaccatggatatggctaaagcggttgctgaactgttggaatcaaaattattttatcctgatggcacgccggtaaaaaccgtgatttctgactcaactattgggggagtaaaagaggcagcagcttcgaaagaaaaatttgataaggaaaatgtttgtggaaccatcacggtaaccccttgctggtgctatggaagcgaaacgatggacatgaccgctgacattcctcacgcgatttggggatttaacggaactgaacgtcctggggcagtatacttagcagcagttttagcagcgcatgcgcaaaaagggattcctgcttttgggatttacggagcggacgtctgtgatgctgatgataaatcaattccagatgacgttgccaagaagcttattcgttttgctaaaggaatacttgcagtcggcattatgcgcaataaatcttacttatcgattggtaacgtagcaatgggaattggtggttcaatggttaacgctgatttcttccaaaactatttaggtatgcgaaacgaatatgtggacatgactgaaatagttcggcgttgggatgaaggaatttatgacaaggaagagtttgaaaaagccatgaaatgggctgaaaaacatactccaatcggaccagatctatataatagtgacgatcctaatcgatttacagacaaagaaaagaaagcacagttggccgattgcgttaagatggccatcattgctcgagacttaatggaagggaacccgaagttagctgaaaaaggatttgttgaagaagctgacggacataatgcaattgctgcgggattccaaggacaacggcaatggaccgatcattttccaaacggcgattacatggaggcctttttgaactctcaattcgactggaatggcatccatgcgccgcacgtatttgcaacggagaacgatagcttaaatggagcttcgatgttgcttaactacttactgactaacacacctcaaatttttgccgacgtacggaccttctggagtcccgaagcgatcaaacgggttactggaaccgagttaaccggattaggaaaagatggtttccttcatcttagtaactctggcgcgcaaaccttggacgcgactggtgaggagaaagtggatggcaaccctgccattaaaccgttctggcaagttaccgaagatgaagcaaaacgtagtctagaaaaaacacgttggattcctgcaaatatcggttacttccggggtggcggcttctctagcaattaccttactaaaggtggtagtcaaggcatgcccgtaacgatgtcacggattaatttagttaagggtgtaggaccagttcttcaaattgcagaaggttatgcaattgatttacctgaacaagtctttaacgtgattaacgaacggactgataaaggctggccttcaacattctttgcgccaattttaaccgggcacggagcgtttaagagtgtttatgacgtaatggataactggggagcaaatcatggtgcaatcagttatggacatattggtgcagacttaattacgttggcatccatgttgcgaatcccagttaacatgcataacgtgtccgaagataagattttccgtccaggggtatggtcactgattggaacggaaaatcaagaagcagcggactttaatgcttgtcaaactttaggtcctttatataaatagcgtgtgatgaaatatggaaaaagtgaatgtaattgcagtagatttaggggcaagttctggtcgcgtaatttccggtcagtttgatggaaaacaaattaaactaaaggagcagtaccgattttccaatcaccccgtcgagattaatgaccgacttaattgggattatttaaagatttttcaggaagtaaaacgtggtttagcgttaacaatgcgagacctaggacatctagatagtttgagcgtagatacttggggcgtcgattatggcttgttgactaaggaaggagaagtactttttgctcctcattgttatcgggacagccgcacggccccttatgaagcagaatttgcagaaagacttccagctaagcaattgttcaggatgactggaaacgctccagatcggatcaataccaatctgcaagttttcgcagacctacaacgggcctcctttttaaaacgaacggttgaccagttgttaatgatgcctagtttgattgaatacttttttagcgggataaaacaaaatgaatttaccattgccagtactacgggactcctcgacgtgcgaactaagaattggaatacaaaagttctaaataggctggaaattccagcagaatggtttgcagacgttgttattgggggagccgatttaggcccgattcgtcaagcaattagtgaagagattaaggtttctgctgaaatgcgggttatttcaggtgttggtcatgatacagcagcagccttaatggcattgccactaaacgaagcggaacgtaaacaaaccgcatttattagttgcggaacatggtcgattgtgggattacaaaatgaccagccaatcattagcgaagcggcttttgaaatggggttgacgaatgaaggttgttttgatggttctaaccgggtgttaaaaaaaattaccggcttgtgggaaattcaagaactacaaaaagaatggacgtatacgggtgcagagataagctttgctaagatgcaggatgaagctacaaaagcgtactcaatcaattcctttattgacttagcagacgtgcgttttgccgaacctgggcaaatggaagaaaagattgtagcctttcttaaagaaacccatcaaactttaccgaaaaatcggggacagttgatctgagtggtattagagagtttagctttttcctaccgacaggtgattgaaaagttagaaaaacttactggaacaaccttgcaaaaagttcatatgttcggcggaggtattcaaaaccagttattagttcaactaaccgcagattttacacagcgcaaggtggttaccggaccagtcgaagccagtgttttgggaaatgtagtcgcccaattaaaggttctcggtaagataactgacccggttaaactagatgttttagcaaatacggttgatgtacaagattttaatccaactgaaattcctggtttagaacagaagtatgcccaatttatgaggatattagctgcaaataatacggaaggaaaataattatggaagaaaatctatctactaaaccaaaaacgaagggaattgtttacctatttgctattttaggaggatttgccgggttactttacgggtatgactcaggggctatttcgttggcgttaccatcgattactatggcttttggattggattcggttcaaaaggggctggtggttagctttcttcttttcggcgcgttgccttcaatcgtcgtatttaccgcgttagaaaagaaaattgaacgacgcaacgttttgattgtcgctggggtagtattcttagcggggagcttgttaagtgcaattgcgacgggaacagttttcttgatgatggcacgtttcgttttaggaattgcggccggaattgcaaatatgtacggtctgatttatttatcagagctagcacctgctcacattcgagggttaatgtcttcactttaccaattaagtgttaacgtgggaatcctggttgcttatgcggttgaagcatacaatttaccccaagatgattggcggtggactttaggactaggggtggtgccagccctgatactgacaatcgggatggtaatgagtccccaaagtccccggtggctaatccgggatggcaaagttgaacgagcacgaaaagttttgactaaagtccggttcaccagtacagaagtggaatctgaaattaaagatattcaaaatagtctgaaaacaaaagaagcagggttaagcgaactatttggcacatttcggccggcccttacgttactaattattttaactatttttcaggtttttaccggaattaatgctgccgtttactacgcaccggaaatttttcataatttaggaatggcaaattctagcatcgtcgctgattttggggtgggaattgctttagtagtctcgaccttcgtttctttgcccttcattgacaagttgggacgaaaaaaattactagaaatcagtttgggtggtcaagtcctaccagcgattgcgctatgtatttggtcagacaacgtaattatcgcggttatttcgatttttctgtacgtgtttatgttcggtttcggtcttggaccggtgttttggtcatatgttccagaaatcctacctttaaaagcgcgtgctttagggatgggagtaatcacctttactcaatatcttttaaatgccattttctcgttgatcttcccaatttgcctaagtattgttggcataaatattttctatttcttcgcatttttatccgccttttcggtttggtacatccataagtatgttttagaaactaaaggacggtcgttagaagaaattgaagcctattgggaatcaagaaagaaggaatgagaatgttaaatcgagtacctaaaaatctatcgccggagctaataaagacgctaatggaaatgggacacggggatgaaatcttgttggcggatgccaattatcctgcggtgtccaataacaaaaaaattattcgagcagatggcttaatgattccagaattacttgattcaattttaaaattgatgccgttagatagctattctgattaccaggcaattttcatgcaagttgtacctggagatcagaacgttcctaatagtaccccaccgatttgggagaagtaccgggatagcattggaaaaagctttaaaaattatacggtaaaacaaattgaacgatccgccttttacgaatattcgcaccaatgctttgccattgtacagacgggcgaaaaagcactgtatggcaatttgattttgcgaaaaggcgtagtgatgtaaaactcctcttttgagaaataactcagacatcgtaagctaattctgtaaatcgaagaccctatctaattacgattttttgtagttgggtagggtctttataaaagaacaagattatcctaatttaaaaatatattcaaagtaattacaagttgattatttatctaagaagatgaaatccatagtgattttgtcttttttatgtaactaaaataccattatgggtatttaaattattttatattagcaatgtataaaggtaaatgatttttcgtaacttaaatttgacttaaaaatagcaatatagtttagtatacccgtggaggtattttaaagaatgaaactaccattttggggacataatactattagtattagtgcaattgcagaacgtaaagaggatttcgaactaattgacgtacgtacacctgttgaatttcggagcggacacattaattatgcaaagaacgttcccttagataaaattaatcgattttctggcagaaaagatcaacccgtttatgtgatttgccaatcggggatgcgcagtaagcgggcggctaaatttttgcgtaaccaaggctataatgccaaaagtgttcgtggaggaatgaaccaatgggatggtccggtaagaaaggggaagtaaaatgagtaaagtagttattgttggcggggttgctggtggcatgtcagcagcaactcggttacgccggttagcagaagatgctgagattatcgtttttgagaaggggccgtacgtctcgtttgccaattgcggattgccgtaccacctttcaggaacgattccagaaagaacgtcactaatggttcaaagtccggaagcattatgggcccggttcagaattgacgcacggcctaaccacgaagttattagtattcaccctcaagaaaaaatagtggaagtacagcatcgagggaaggttttccaagaaagttacgatgaattaatattagcgaccggagctagcgcaattattccgcaaattgaggggcttacacaggctaaaaatgtgcataccttaaggaacattcccgatatggacgagattttaaaccagttggagcaaggagtacaaaacgcaacgatagtaggagcgggatttatcggtgtggaaatggttgaaaatttacataagcgggggatccacgttactttggtagaaaaagcaacccatgttttgcctaacttggatgctgaaatggcagcttttgtggaagaagagttgttaaaaaataacgtagatctccaactttctaaagcggttaccgaaatcaaggataatggaactcgccttgttttagatgacggaactcagattaactccgacctaacaatcttgtccgttggagttcagcccaatagtgttctcgcagaaaatgctggacttcagttagacttgaaaaagggcattatggtggatgaaaattacgaaacgagtgtgaggcatgtttatgcagttggtgacgtagcggtgactaagcagcagattacaaacgaaccaactttaattccgttagcttctccggcaaatcgacaaggacggcaagttgcagatgtattagttggtttacgccgcgtaaatcggggcaatattggcacggcaattgtgcaagcgttcaatttgagtgcggcttccaccgggttaaatgagcagacggctcgacagaaatttgctaacgtcttagttgctcacgtgagcggcacggaccatgcgacctactatcctaatagtcaggcgatgtggctcaaactgatttttgacggaaagacggggcaaatttatggtgcgcaagcagttggtgcaaacggtgtcgataaacgaattgacgtgtcggcgacagcaatcaaagggaatctttcggtatttgatttaccagagctagaattaacttatgcaccgccgtttggcacggcaaaagacgttgttaatatggttggttacgttgcagctaacctggttgaaggattaagtaaaaatattcaatggcacgagctatctgccgaattagcaaagggtaaacaattacttgatttgcgtgatccaaaagaaattgtaagggatggtcggattaagggtgcaaccaacatacctttaaaccaattacgggagcacactgatcttttggatccccatcaggagtacgttctttactgccaaagcgggttacgaagctacgttggagaacgaattttacgacaaaaaggatttaaagttgaaaatttagatggagcgtttgggttatataaaacgataatgaaagaggaagttgaacagattgaaaagtattaaagcaaaagatttaatgaagaaaattgaagataagaaggtaaacgtaattgatgtgcgggaaagctttgagttcgggatgggacatgttccttccgcaaagaactttccactaagcaccttacaagatacagctaaaagtttagataaaaatcagacttactacgtcatttgtcaatcaggtgcgcgttcggctaatgcttgtggttatttggaccagcttgggtttgatataatcaatgttgaaggtggaatgaatgcttggcaaggagatattgactaaatggctacgtgtgatcaacaaattttaaatcgattaaagcgggcggaagggcaaattcgaggaattcaaaaaatgattacggatggaaaagaatgttcggaaattattccccaattaaatgcagtaaagtccagcgtagatcgaattaagggcatcatggttgccgaaaatttaaaagattgtttagaaaatccggcgaatgataaagaaacccaggatgaaaagattgcgcgagcaattgaaatgatcgtaaaaaaataaattttagatggcaaattaaaaaggcgaagtttagaattcgagttgaattcagcttcgtcttttcgtttaattaatatattattttgcgtcatatgcagcttggaataatgcgacgatttgttctttagtagctttccgtgggttggagaaagcattgccatctttcaacgcattttcagccattagttcgaaatctttaggattggcaccgagatccttgatgctccgagggatgcctacgtcgtcgttaagttgttgcatggcatcaattgctttatcagcagcttcccgaacggaaagcccgtcgatattttcacccatcgcaaccgctaaatcggcaaaccgttctgggcaagcaataatgttaaagcgttccacgattggaagtaatacagcacaacagaccccatgaggagcgtcgtattgtccgccaagttggtgtgccatggcgtgtacgtaaccaaggtcagcgttattaaaagccattccaccgagcatttcagcttcaaccatctttgtccgcgcttcgagattttctccattagcaactgcttcacgtaaactttcttcaactaagcgaattgcttggaggcattgaccatccgtaatatcattatggttagtcgaaacgtagggttcgatcgcctgtacaaaggtgtccatcccggtagcggcggtcaattttggtggtacgccaagcattaattttggatcgttaaacgaaactaggggaacgttgcgccaggaaactacgacaaattttaaatgggtttcttcgttggtgattacgcaatgccgagttaattcagaagccgttcccgcggtagtatttacggcaattagtggggggagcggattatctaaagtttcgatacccgctaacttggtgatgtcatcaccgttcgttaaaattatgccagttcctttgccagtatcgtgagcagaaccgccaccaacggtaatgattccgtcacaatggttatctaagtaaacctgtttagcttccttaatgtttcttactttaggattgggttcaacgccgtcgtaaatcgcaaaatctacttgagcatccttaagtgagttgatggtttgctctacaggaccgttctccattttttctaagaattgatcggttactaataggggctttttcatattcaccatttttgcacgttcaccgatcttattaattacgcctgcgccaaaaaagtttacgcttggcatcaaaaaatcaaagttttctttcattacgaggacctcctcaggtacgctttagtaactttgtacactttaatgttaccactctaatgaaaacgcttcaattgagcaagggtagaaaattataggagaaactaattagatttagtagacaaattttaccgtatttaagttttgtaaggtattgttgattagttattttaaataattaggctctaaaaagtgtcggttaattaatcaattatcttgctaatcgtaccgcaatcgggtaatataaaaaggtttagcaacccaattggataccaataataaggttaagaaggggattacatcaacacttaaagcgattgttaatggtaacaattttgttgaagtgcttttttatggtacaccctaaaagttcaaaaaataaggaggaagaaaagtgaaatacgggtatgcaagagttagctcaaaagatcaaaacctttcgcgacaattagccaggttaaaagaagttggggttaatcgaatatacaaagaaaagatttcaggagcaattaatgaacgccccgaacttgctaaagttcttgatgttttaaaacctggcgacgagctttatgtattagagatggaacggctaggaagaaataataagtttttaactcatatttttatggaagtttatttacgggaagctaaactgattatccttgatttaccaacctttgacgacattgatgatgaaaatatgcgaaactttctacaaaacatttttatcgagaccaagaagtttcaagcagaatcagaacggcaacgaattcgaattcgtcaacgacaaggaattgaattagcaaaaaaacgcggggtataaaaaggacggcccgttttatatggcccagacgttaaaaatcctaaccggcgtaagatttattttgatattcgtgataacttagaagctgggaaaagcattatggcaattaaaagaaaattaggtgttagccgtacgctaatttaccgaattaaatctgaaatgtcataaattaacacctgcaaagatttactttatgtaagtagtagtgttttggtgtacaataaattgaaaagttagttacgatctaatgattatacatgttgatagttgatgtctttttagggtgtaccctaaaaagacactttcaaacagaaaataagataccaaaatttggggaggattacgatgagaatccgtatcgatatcactggaaaacgttttggaaaacttgtagctcagtatccagttagatcacctaagactggtaaattgcagtggcattgccagtgtgattgtggaagggtgactaatgttgatttgcaacatttaaaaaccggcaataccaaaagctgtgggtattgtacaaaagttcgctacgatttaacaggaaaacgctttggacggctagtggtgacgggacggaccaaccgtaaaagtacttcaggcaattattattgggcttgtcaatgtgattgtggccgaaaagtggatgcagaaagctatttactccgccatggcaaggttaggagttgcggatgcttacgaaaggagaaatccgccgaacgtttaaagaataatcgaaagatatctgctcaaatgggagctaaggacgcttttcgggatccaaatggcaatccaattcaatcggtagtgactagttcacgtaatcaatcaggtgtggtaggggtttcccttaactcttctggaaacaaatgggtcgcccgcatgatggttaatggcaaaatggttttaaatgagtcttacgacgaattcaatgatgctgtggcggcacggcgaaaagctgaattaaaatatttaaagtaattaaaaatttttttgtagcattaaaaaggagttttcagtttaaaactgagaactccttttttaaggataaaatttttttgaaaaaaattaccttggtgcgttgactttagtaaagtcaaactgtccgacttttgtttaactcgttttttcgagatctttaattttgagtaggttattttcctggaacgtagtcagaatcaataatcaagactggtttaataacttctccggaacgggatgcttcattagcttccttgatatcttcaaacttaaagaatttctcggttttatcaaagtcaaacataccagctttgtaaaattcaattaaacgaggaatgtcgatttgtgggattgagtctcccatgttgacccccacaatcttcttgtcatctacacaaaggtcgttccaagtgtctaggtcaatgtgatttggcgtgacggcaatggttgcggtggttccgccttgggtgagcacttggatagattgttccatcacttgggtgattccagtggtgtcgacggcccagttcaccccgcggccattcgtgagtttcttaacttcttcaaccacgtccacgttacggctattaatcacgtcggtagcgcctaattctttagctaattctagccgagaatccacaatatcaattccgattaccttagtgcatccagaaattttaccagccatcatggcggccagtccaaccgccccggtaccaaaaacagcaatcgtatcaccaggccgcggtttgagagtattaagcacggttcctgaaccagtaacgtatccgcaaccaagcgggcctaatttacgaagatcgagttcgtcatcgaccttaacagcgttccgttcccgaaccacggtggtggtggtgaaggagctttgatcaaacatgtccgcaacgtgttcaccattttcagtgaaatgatcggagccatcgggacgtacaccagaaagattgttggcagcataattacggcattgggtaggggatgcctttcaaacaattatcacaattaccacaagcgtagaaacttaaaactacgtgatcgccgggtttaaattgagtaacttctggaccaactttttcaacaattccggcaccttcatggccaagaataattggataatcaattactgcgtcgccaactcgcaaggcttcgtcggagtgacaaatcccgctagcaaccatgtgcacttggatatcatccgcacccatgggggctaactcaatatcgtctttgatggtaaaatctgcgttttgtttttcaacaactgctgctttaattttcatattaacaaatctcctttgtgcttttatgttttaacaggttcattatttcacaaaagaaagcgtttgcaaagagagaattcggtgaatttgtttcagaaaaagctgaaaaataatgcactagatgaagaaattttttcaaaaaatttaaattaacgatcatctcctggcttcccgtggtaaaactcttcgtactttttataaaagaaggtcttattagtgatgccaatttgatgcatgatttcggtaatgggtaggttggttgaagaaattaagttacgggcttgaatcaaacgttgctgtgtgactgcttgagtgaacgtctttccagtaacttctttaaacaggtttccaagataatttttactatatttgtatttacgtgctagatcatcaagacgaattgtttggtagttttcggcaatttgtttaaggattttagtgaccaaaatttgttgtttagtgggatgttggccgatatcgaggggatagtggcggacgagaagtacaaataaaatttgtagataggatttaatgattgagttagaaaaatctcgttttaaataatattcttcgataattttatccaaaacgttaggaatttcatggccggatttatgcttaaataataaaaaatttttcgtgccagttgcatcgtcaatggctcgatcaattaaaaactcgtgcaaaatactattactgcgacgaatgtcatttaataaattaatgctaataacttgtcgtttaaaaagaatattaaccaagatatcgtgatcacctagggcagcgatttggtgctttgcgcagcaataaatcaccggtctgtagttcaattcgctgatcgttaactatttcagtagcatgcccttgaagcatgtaattcatttcgaaaaaagtatgactgtgtgcggggtagggagcataacgattgtggcgactaatgtaaacatctcgattcttaaataaattgttatttagaatttgaattttatcgtcgcttaattcgccagtttgaagaacgtaagatggcatgtcttcaacaaaagatcgcttaatcttctgtttttcctcaactatattagtttgtgacagcatgtgcaaggctctaggattcatctgaatacctcctgtaaatatgatacttttcatgaagaactaggatattttatcacccgttgtaaacgattacaattcggaatgtaagcaaatataaatgatttgagggggtattgaaatgagtgaagaacaaggatcgtgaaatcgaccattgccgtatcaatcacgaattttttagattcaggctcaattgtcgctggagccagtggattgacattttggacaaaggaactgggtctttctagtttccaagtggggcttttaggcgcgttgagtgccaacgcgtttggttcagcaattggagcgttaatcggtgggcatctatcagataagtttggccgaaaagtaatttacacttatgacatgttagtttacatgctaggaactgccattattgctttttcaattaattttccaatgcttttggccggctttttaattacgggaattgctgtgggagctggggtgcctgcgtcctggacttatatttcagaaacatcgggttcaactgatcgggcaaagaatattgggatttcccaatttgcttggtcaatgggaccagcaatcatttttatcgcggggaccattttagcacctatcggtttgcttggaaatcgacttttattcattttcttaacgattgtggcatttattgcctggcgcttgcaaagcaaattggaagagtctcaagtttttgaagagcaaaagcaggctgaaaaagatagtgggatcactttccatccgtataaagatctattttccaacatggttaatatcaagtcactactttttttgattggcgtttacatgttctggaatctagttgctggcgcaatgggatttttcatgccgtatgtttacgaaacggttgggggattaaccaacatgcaagccaacttattgcaagcagtactctggattttaactgctttaggtacttatgtcgggttcgctaaatttggtgatcgagcaaaccaccgaattttctactttgttgggtcggcaatggcagcagcgtcatggattgtattaacttatgcgggaatgaattggactagcttatggcttttcgtaattctttggggcgtgtctgctggaatcggcgcgcaagcttggtatgcattatgggctactgaactatttccaactcgctaccgggctggttcgcaaggtgtaatgtttttcgttgtgcgaggatccgctggaatatggtcaattatttttccaactattttaactagcatgggctttaaggctgccggaactttcatgattgcactattgattgtttccttagtgattgggacggtttggacaccgcatactcgaggaaaatctctagagcaaattagtaaggaacgttacggtaatgaccaagattagtttggaaagaaggttggtggaaaagatgaaaacatacgttgccgttgacatcggcgcatctagcggacgcctgatgctagctcaacccaccgcggatgggcggcttactttagaagaggtccatcgatttactaacggtttcaaacttaaagatggacatgaccgttgggatattgaccatttgattcacgagattctcgtggggttaaccaaggtcaaggcgcgggggattaacgccattgaattaggcattgatacttgggcagttgactacgttttagtaggttttgacggtcagaagttagaagatccaatcagttaccgggatcggcgaacttcccaggcgattaccgaattaaccagtgaattgccgaaggaatacatttatgaaaaaactggaatccagttccaagactttaacacgctgtaccagctttacaagactgatcgagcattactagctaaaacggacaaaatcatgatgattcccgactacattggctatgtactaactgggaatgcagttactgaaattactaatgcatccaccacgcagatgttaaatttacgggtcggcttgtttgataaagacttgttggccaaagttaacgtctctccagaccaattccctcggttagttgaatcaggaacggttttgggcaacttaggtcataaatggcatcgccaattcgatttgccagaaactgaagtgatcacggtagcgacccacgatacggcttcagcagtagtgggaactccaggccagggtgaccgctgggcattcttaagttcggggacctggtcgcttctgggcaccgagctgaacgttccggaaaatggtttagctgctttccatgaaaactatacaaacgaatggggggcttacggaacttaccgtttcttaaagaacatcatggggttgtggattgcgcaatgtgttcgtcgtgaattagcagatgaaattagttttggagaacttgctaaacaagcggaagcagtccgcccgttccaacagttcatcgacattaatgatccccggtttgtcaatccggcaaacatgacggctgaactacaaaattactgtcgggaaactcaacaaccggttccagaaacgccgggcgaacttttccaagcgatttacagtaacttatcgttatattacgcaaatgagcttcaaaaattagatcaaattttaaactaccatattgaacgacttaacattgttggtgggggcagcaacgttgccttgatgaatcaacttaccagtacgctagccaatgtggaagttattgcaggacctagcgaagccaccgcaattggtaacgtcttagtccagatgatcgcaacggacgccgtggaaaatattaatgcgggacgccaattgattggtaagtcgtttaaattaaagcattattatccggaaactggtaaatatggcgacattttacaacagtaccaacaatttattacaagccaagtttagaaaggagtggtatcaatgatccgaattggacaagtgatgtatttacacaaagatgcatatgccgaatatgcaaaaaggcatgccgagctatggccagagatgaaggaagctcttaaggaacacggtgcacataattattcgatttacttaaacgaaaaaacggggcagacgtttgcctacttagaagttccagacgtggccaagtacaacgaaatcgctcagacggcaatctgtaaaaaatggtgggcttacatgaaaccattgatggaaactaatccagataatagtccggtgaccactgatttaaaagaagtctttcacttagattaaataatttttaggaggaaaataaaatgattaaagcaaacgaagtcgaaagcgcatacaaagtggctcaagcgcgttacgccgaaattggggttgataccgaagctatgttggctaaactggcgaagattaaattgtcggtgcattgttggcaaggtgatgatattcatggatttgtgaatcccgaacaagaattgacggggggcattggggtttctggcgattatcctggtatggcgcggactccggatcaactaacaggtgatttatcggaggcgttaagcctaattcctggaaatcataaggtggcattgcataccttataagcagttactaatcagaaaaaggactttgacgaaattggcccagaagacttcaagtactgggttgattgggctaaggaagcgggcgtaggtctagacatgaacccgacctttttctcacacccaatggttaaacataactttaccttagccagtcccgaaaaagacgtccgggacttctggattaaggttggccaacaatcccgggcaattgccaattactttggggaagaactgggtcaacaatccgtaaacaacttttggattcccgatggtttcaaggataatccgattgacaagcttaatccgcgtctccgactagtcgaatcgctggataagatttttgctaaaccgtatgacgaaaaaaatactattgaagcagtcgaaggaaaactctttggcacgggaattgaatcttacacggtcggctcccacctcttctacaataactacgccattagtcgtggtaaattatggaccattgatgcgggacattggcatccaaccgaagatgtctcggataaattctcagccttcctgccatttgggaaagggttgatgctgcacgtttcgcgtccggtacgttgggacagtgatcacgtggtaatttttgacgatgctttgatccggattatgcgttcgttggttcgtgatcaagaactagaccggaccaacattggcttagacttctttgatgccaccattaaccgggtggctgcttgggtaattggggctcgggcaactcagaaggcattattacaagcgcttttaactccaattgatgacttgaaggaagctgaattaaattatgactttacgaaacgtttggcagttacggaagaattaaaatcttatccatttggggcagtttgggacgaattttgtttacgcaacaacgtaccggttggcaccgattggctcgcaaatattcgggattatgaacaaaaagttcaattcccgcgggatcaaaaataagattgatagaagaggcggaaaacgatgaaatttattgactcacaatacgtgaaagaaatgaaacaaaccacgatgaatttataccaacacggttgggacgaacgtaacggcggtaacgtcagcttgcgactaacgactgaagaagtgcgcgcatttagcgacgttactaaaaccctccgttccgtcgccattgatttcgatgcaagtgaactggctggaaaatattatctagttaccggtacgggacgctactttaaaaatattaccgaatatcccgaacgagacatgggcttgatccaaattaatccggatggtcaaagcgtggcgattaaatggggctttaacgacggtggccaaccaaccagcgaatttccagcacacttaatgagtcaccttgcacggttaaaacaagatcccgaacaacgtgtaattatgcattgccacccgactaacttaattgcgatgacctttactttaccattgtcagaaaaactattgagtcggactttgtggcaaatgcatcctgaatcaatcgtggttttcccagaaggtgttggggtaattccatatatgtgtccaggaactaccgcaattggagaagctactgcaacaaaaatggtagaccatcatgtagtagtttggccacaccacggagtatttgcggccggggactctttggatgagacgtatggactagtggaaacggttgaaaaatcagccctcgtatatacggcgattcaagcacaaggtggccaaatgtttcaaaagattaccgaccaagattttcgggatttagcacaacggtttggattgagtttgcgcgaggaatatctggaagattaggttaaaaatttttctaaggaattgagttaaaagactcaattccttttttgcttttagacaatcttttatgtagtagaaagttggtgttggtcacttttttgttgaaattattttcacgaattgcaagaatttcgaaataaatacccatatatatgaaaacaattgcaaaaacaatggaagcgttttacagttgtgatggaggtggaaataatgcaaaaaagtagtaagggcccaatgaaaattgtggcggtaacggcttgtgcagctggaattgcgcatacatatatggctgcagaatcaattgagaaagcagctaaagctcgcggagaccaagttaaggtagaaacagacggggcaatgggggctgaaaacgtactaaccgaagcggatatacaagctgcggacttagtaatcgtagcagccgacattaagattgacccaattcggttcaccggtaaacgattatacgtaaccgattcgaacgaggcgattgatgatggagcggctttgattgaaaacgcaattgccaaagcagaagtttttgggaagaaaggtactaaggtcggtaaaatcaaaattggtaacgaccataagaagaatggtttctttacccacgtaatgaccgggatctcgtacatgattccgatggtaatctcagcgggattaattttaacgattgcgaacttgtacgcgtttcaacgagatagtgcgggacggattgttaaatggggatttgataaccatactcaaatggggttattgatgtcaaatttgttccaggtaggacaagttggctttaaattaatgattccattgtttgctggttttgtggcaatgtcgattgctgataagcctgccatggcaccagcaatgattggagcatatattgcaaacgacgcggaactgttacacgcaaaagcgggcggtggatttattgcggctttattagtggcatttattgttggttactttgttaaagcacttaaaaaaattaaatggccaaaaataattcaaccgattgtacccattatgattattccggtgattgcgacgctgtttatctcgttagtggtattttacttgattggtagtccgattgccgcgggaatggacggcctatactcctggctaaattggattaacgcgcactcaacaagtgctccaattattttaggcgcaataattggtgcgatgatgggcttcgacttaggtggcccagtcaacaagacggccttaatttttggcacggcagtgtttacagatacaatgagtaaatatgggattacacatgccaactttgttccgggaactgctgcccaagctgcaatttcagtagcaccactcggagtttggttagcttccgtaatttggaagaagaagttttctaaggatgaaaaggcggcagctagtgcggctctaggaatgggcttagtgggagttaccgaaggagcgattccatttgtagctgcggatccaattcgaatgattattgctaatgtatgtggatcagccgttgcgggtggattagtttctctaaccggatgcaagttctatggtggaattggttcgccactaggaacctttattggttacattgaacaaccagttccgttcatcacttggattctttgtgtatgtgcgggaattgcggttaccgctgtcattatcggatttacgagaagcgatgccgttattgaagcggctaaagcggtagaagattaaaagtgaaaggaaattgacatttatatggatgcaaatgttttttctaaagcaaatattttgtttgatcatgacagccaaactcaagaagaggcttttcatgccattgcgggacacgttaataaactgggatatgcagattctgtagacagtttttttgcgggattaatgaaccgagaaaaagagactactacgggttttaaaaacggaattgccattcctcatagtaatgacgcaagtgtaaaacgtcccggactgttcgtaattaagtttgatcaccaaattgaatggaacgcacttgataaaaagccagttcaagtagcgattgcgctatcaattcctcaagaaggatctaaggaacatttacggcttttaagtgaaattgctagaaagctgatggacgaagattttactaaaataattttagaaaatgatgacccagacattttagctcaagcaattaatgaaatatagttccataaccaaaaagtggaggctgggaaacatctttcagcctcttttttattaaaaatattaggtttaggagaaagagtagtaatgaaaaaaatacacgtaattcatcatacccactgggattttgaatggtactttacgagagatgaagcattggttcaatttgtttatcacatggacgaagttttcgcagctttacaagcgcaaaaagtcgattactacctattggatgggcaaatgagtattctagatgattatttagatgcttatccagaaaaaagtaaggaaattaaaaaatgggttaacgcaggtcgactatttattgggccatggtatacccaaacggatgaactaattatcaccggcgaatcaattgttcgtaacttaagtttaggaatgaaaatggcgcaacggttaggaggagcacaaccaattggatatttgccggactcctttgggcaaggtgcggatatgcctaaaatttataacggaatgaacattaaaaacgccgttttttggcgggggctgccgaaagaaaagaccgctaaccgtgaatttatttggaagtcagaagacggctcacaagttaacgttgctaacatcaagaacggatactttgttggggtcggtttaattgaagatgacgacgccaaaaacatgatgactacggtagttcaaggcgcaagtgtcgacgacgtcccgttgccggtgggtggcgatcaacgttatgttgattttaatttaaaagaacgaattagcttctataatcaacaacttgacgatgcagagttagttgaaagtaattatgttaaatattttcaaaatctaaagcagcatcaaaatgaattggatcaggttacgggagaatttattgatccttccgtgtcgaaaattcaccgctcaatctattcgtctaggtacgaccaaaaatatcttaatgataaagtagaaagacgaatgatctaccaagtagaacctttgatggcgatggctgaacgtgcggggatcccttataaaaaagctttgttagataaaatctggaaattaatcgtgcgtaaccatgctcacgatagcgctggtggatgtaatagcgataaaacaaatcggatgattttggcacggttggtagaggcggatcaattatcttattcggttgttgattaccttactcgtaaaattactgagtcagatgtgagctatggagaaaatacgattactttctttaatacgttaccatatccaataactaaacgagttaaattccaattatcactaaagaaccctgcctttaagctaatgaaggacgatcaaaagataatggtagacgttgaaaaagtcaccaaagaatatcacgggcaaattaagcgggatactaatgcgtaccaagatggtgatttctactacaaaattgactgcagcgcgcgaataaaccttccggcactacagtgggaatcttttgatattgtcgctagtgaaaccgtacccgcattattgggaaatacaacggacaaatcgattagtgataaccattttaaaattgaatgggttgatggaaagctaaacttgactaatttgaaggatcaaactttggttgaagactttatgtatattgaagacggcggagacgaaggggatacttatgattactcgccggcttacaaagatcaagtttatcgtttagattttaaggacgctgcggtcactacccgtaaaggacgggtgactagccaattaattttacaaggaacctgggcagttccggttgacttagcatcacgggcagaaaacttgcaaaatcaacaaatcaactaccagttagagctcgagttagacggaagtggtcggattaatcatgaattacaaattcacaacgaggccaaggaccatcgcatgcgagtgattaatcgcactaacatttatgctaaggcctcttacgcggacactggttttggttatattgaaaggccagtagtggatcctcacttaaaggattggcaagcaattggctatcacgaagaacctacggccatttttccgatgatccactacggtaacgtacacgatgatgaacgtagtgtcagcttcttaacaaaggggatcaaagaatatcagattacgggcgctcaacatgatcgagtagccttaacattgtttagatcagtaggttacttggggcgcccagatttgctccgacgtccgggagtagcgtctgggaatcaatttacctatattcctacaccagatagccagctacaaaaggaaatgcattttaaatgggcaacgtacattagcaaacagtttgatccagctgaggtaagtaaagagtttatggagtatgcggtgactaatccgaactatcaagcccaagatttaaatcagtttactaacactttgaaatactttgtgatgcacccgctaaaaaatccggttaaagcacaaccattttttgaattggttgaccagcgaatcacctttagtagcttaacaaaaagcattgacggaacggcagatttaattcgagtagttaatttaaacaagcaaaaagttcaaattgatcaactcattaacctcgataagcagtattatataaatgaaaccgatttctcagggcggattagaaaagatttaggctatgcggcaagcattgaaaaaattagcttccaaccgggagaggtgaagacctttaaaatagcgagatgagtatatgagtgaatcaatgagtaatttaatattgatgattgaatcaaagcgggaacaatttacggacgtggatcaaataattgccaactactttgtcgctcaccaagaagtgcgcgacattaatggattggccaaaaaattagcggtatcaccgtcttcaattactaggttcagccacaaaattgggttaagtaattataaggagctagtgtttttgtataaagaatacctaggctcgctaaaccgtaaagtttcgcgaatttcaagtgacgtagtggacagttatcgggccattgcccaacggacgagcgatcgttacgatgaacaaaccgtgcaacttttctgtgaaagaatttttaaaaatcgcattattttcttttgggggttaggatttaactcctttgtcgggctagattttgagtttcggtttgcccggtttggtaagatagtccaacattttagtgatcagcagtcgatatccttaaacgcaaattttttaaaaaaaggcgatactctgctaatctcttcaattagcgcaaaggacaaatccatacttaagtcaattgaaacagctaaagctcgtggcgcacatatcttattgattactgctaatcatgaatcggcttacctaccatactgcgatggagtaatgtatactgcaagtttttctccagaagagtcgttaggaaacatttctccgcaggttccagcgctaattgatctggatattatttattcaaagtacattgatttacaccaacatgatttatctcagtgggctaaatctgaaaatatattaaaaaattggaggaagagttaatgcaatttcctgaaaactttctttggggagcggcggcgtcagctccgcaaacggaaggacacagcctagaagatggcaagtcggccactacctgggacaagtggtttgcaatgaatcctgaaaaattcaacgaaggacaaggaccagaaaatacgtcaaacgtatatgaagagtatcctaacgatgttcaaattatggaagatttacatttaaattcgtaccggacatcaattgcctgggcccggttgcttcctgacggaaaaactttaaacattgcggcggttaaattctatcggcagtatttccaagagttaattaatcacggagttcacccgattattaaccttttccactttgacatgccctggtggctaatggaaaaaggaggttgggaaacacgggaggcagttgacgcgttttacttttatgcgaaaacagcttttgagcaatttggggatttaattacggattgggtaacgttcaacgagccgattgtgcatatcgaaatgggttacttgtacggtttccattatccagcggtggtggacttcaaaaaagctattcaggtagggtatcatacgttgatggctcacgtcatggcagttaaagcgtttcgggaagcaaacatttctggtggaaaaattggaattattttgaatgttacaccggcttatgcacgaagcaatgataaagcagaccaaatagctaaggaaactgcagatttattattgagtcgcagctttcttgatccagcagttttaggagaaattccgccagagttgattgacctggttaaaaagcatcaaatgttaccggaaactaaagaatcggacagaaagctgattgccgaatataccgttgatttcatcgggattaattattatcagccactccgagtcaaagcacccgagaaaccaaattttccagctcaaaataccgacgatttatttgctaattacgaatggccagagcgccgaattaatccataccggggctgggaaatttacccagaagcattatatgatgtggccatgatgatgaaagagcgttatcacaacattccttggtacgtaagcgaaaatggtatgggagttgctgatgagcgccggtatgccgatgcaaacggacaaattgatgaccaataccgtattgactttattaaagaacatttaacccagttacatagagccattacagagggaagtaattgttttggataccatttgtggactttcgtagattgttggtcctggctgaatgggtaccgaaatcgttacggtttagtgagtgtcgatttagataatcattatcaacggactattaaaaagagtggctactggtaccgtaatttaattaagcaaaatggcttttcagtggaggattaattaatgaagaatttaattacaattgatgtagggggcacgtcaattaagtacggattatggcatgaagaagaccagcgccttagtgatcaaggacaagttgctacccccgccaagcttactgatttttaccaagttttacaaacaattagtgcaaaatttactaacgttgctggcgtagggatgagtattccaggggcggttgaccaaaataccggagtgattggcgggattagtgctttgccatacattcataattttcccatccaaaaagaactcgaagaaaaattagggctgccagtggcgatggaaaacgatgctaactgcgctgctttagcagaagttgcgttgggtgccgctaaggacatgcaaaatgttttattcgtggtaattggtaccggggttggtggagcagtcgtagttgatcgcaaaatcgtgcatggccaccaactttatggtggtgaatttggaatgatgctaggactagataaccagcagttaagcacggtgggcacggctgttaaagttgcggaacgatacaatgtgcaaaaaggcacgcaatggactggacaacaggtttttgaattggcaactaagggcgatcaattagccattacggaagtgcaaaagatgtatgctaacttagcgcacgttatttataatatccagtttagtaccgaccccgaagccataattattggaggaggtatctctgctaaccgagaatttattaacggcttgaaccaaacgttaagcgatttagtgggacaattaaacggtatcccaatcacaccccaagtaattgctgctaaaatgcataatgatgctaatttggtaggggcggcttacaatttttatcattaaatatagatgaatagtcataataataaacagctactgacatattaagatgttggtggctgttttttgttatattaactaaataatgtgatttttccgaaattcacttggtgagcagtttaagtagcgactaaaaacccgacttaaatagaatgaatcattaaaaccagttgtatcggctatttctgttagcgagaggtcggtagtaattaatagggattgaacctttttaagtttgattttggtataaaaactaattggagactcaccagttacttttttaaaagttttagaaaagtaggcagcattaagtccaacttgggaagcaattttgctaatagaaagtgttaaatcctggtgcattagattaattgcagcagtaattgtctgactacgatgacgaatatttttcggggctggttgaaaataagtcataattttagtgatcataaaatcattaacaatgtgattacgaactatttgagcacggggatgaaaactaaagttcgttttctttagcatgctacagttttcagtaaagcggctagtagagtagtggtgatttccaatcatagaatgggaaatgtcagtatcagaagtcaaacggacgaagtgaaaagtcatagttagtagcattttacgctgaaagttagtatatggcggaacgactaaaacatcatttgctttagcaaccccctcatgattattgaagtggtaccaacaagctcctttttcaatgatgtacatgacgtattgtgaatctacgtcagcactaagttgaaaacggggcttattttgccaatatgcatatccagcagtttcaacagacatcggaaaatcctcctttgtattttgacaaaaataatacatgtttaactaaaaaaagtaaattgtgcaaatggtcacaactgggtatcttaagaccaaggaggcgaatatgatgttagaagaaaatgtaaccgctgacataacggtgattggtggcggattagcaggtgtttgtgctgcaatcgccgcagcacgcttgaatcataaagtaacgttagtacaaaatcgaggagtcttgggggggaattcaagcagcgaaattcgtgtatgggtggcaggcgcaactaagcatggagttaatcgatatgcaagagagacgggaattatgggggaattatttgtagaaaatcagtaccgtaatccagagggaaacccatacttatgggatgcattattaatggaaaaggtaaaagaggaaagtaaaatccgcttatttttgaataccgaaataatgacggtgaaaatgcaggaccatcaaaagatcgaatcaattacaggttttatgtcaggttcagaaaggctaattactttcaagagttcccactttattgattgcagtggagatggcatcgtagcttttttagcgggagcaaaatttcggcttgggcgagaaagtcgggcagaatttaacgaaagcttagcaccgcttcacgaagataaaacgaccctaggtagcacactatttttctatactaaggatcttggtcgtccagtaaagtacgttaaaccaagctttgcaagagacattactaagacttcaattattaaaaatcgaattattaaaaaagaagataatggttgtgcttattggtggattgaatggggcggtgagttagacgttgttcatgataacgaaaaaattagggacgaattgcaagctatcgtatacggaatttgggattatattaaaaattccggaaattatgatgctgataacttaactttggaatggattggttcagtacctgggaaaagagaatatcgtaggtttgaaggagattatacactaaagcaaactgatattgaagaacaagtgttgtttaaagatcggattggctttggaggatggtcaattgacttacatccagcttctggcgtttacaacgactctgttggcgcacaacattccgttcctgatggaatctatcatattccatatcgcatactgtattcaaaaaatattagcaatttatttttagccggaagagatgtttctacttctcacgtagcttttggaacggttcgcgtaatggcaacctgcgcagtaatggggcaggcagcagggactgcagccgccattgcagctaaacataacgctaatcctcgcgatatttatttgcactatttaaaggaatatcagcaaactttattgagagaagacggtgcgatattagggattaaaaatcaagatgaacacgacttagcccggcaggctgacattacgtccactagcacattaacagaaatcaacacttacgtggcgaatgctgaaccatatcgattaactaaagcagcggcttttaccattcccgtagatcctcaagttaaccaattggatattttttttatcaaccgaaaaggcgacttctttaatagttaagtggtacagtaccgggaatccacaaaattatattccggatactttaattggcaaacaaaaaataaaaatcgataaagggtttaacggatggcaagaagtaaaagttaattaccaacctagtcatgcacaaaacttatttgtggtaattgaaaaaaacgaagactgtattttatatctaggtaatcaagaatttgccggagttttgagctatgtaaataatcctattgccgaattgaaccagccggagctgcatgattattctcgaaagagtccactattgtattggacaaatcaattaattaaccggcggaactttgtttttcgagtaaaacaaactaacgcatttcaaccaacgaaaattattaatgggtatgttcgaccttatggtgggcccaatatgtgggttactaattttaacggtcaaccagaagccatcgaactaagttggaaaggactccagaatatcaaacagattaacctgacatttaacgatgacgttaacgaagatattattaatctacaccaccatcgtacgtattttgatgaggtccccgaactagtaaaggcgtttaacctatactactgggaagccggtagttggaaacggtggtggtcggtagatcaaaatcgtcaacggcatttggtgaaagaatttgagcaacctattcagactaataaattgaaattagagttactccaaaccaatggtagtcaacagttttctttatttgaagttcgagtatattaggaggttcgtatggcacctttagaaaagtctaaaagattatcaacaaatatgcgctacgtaattttagcttttgtttttattaatatagtgattaattacatggaccgtacaaatgtttcgattgcgatgccggaattatctaaagaaataggactgtcaactgtccaacaaggccttatcttttcggcatttggttggatttatgctgcgatgcaaattccaggaggaatcttgctagataagtttggttcccgaataatgtacttcattagtttatttggttggtcattggtcacggtatttcaagcattcattagtgggtttgggcaattaatgggattacgactaggggtaggattttttgaagcaccggtaatgccagctaataaccgggcaatttcttattggtttcccgaagatgaacggggtacggcaatcggaatttattcgtccgcccaattcttaggattagcattttcaactccaattttatacggaattcataattcaattggttggcgagggcttttcgtcgtaactggagtagttggaatcatctggtcaattatttggtatatattttattctgacccagataaaagccgatttgtcggccaagacgaattaaaatatataaaagctggaggcgcaattactgacgatgatttgaagaatgttgataagcacaaagttaaacttaattcgcaaaacatcaaacagctattttcacgaagattgattggaatttatattgggcaatttgcaatttcggggacgttttggtttttcctaacatggtttccaacctatttaacaaaagcaaagcacgttaattttttgcagtccggttttttgtcttcaattccatatttagcagctttttgtggggtaatattggcaggatttatttctgatcagttaattaaaaaaggacgttcagctagtttggcccggaaagctcccgtaattacggggctattgttaacgcttttaattttaggggcaaactttgtttctaatccagctttgattatcttatttatgtcgattgctttttttggaaacggcttggcgaccattacttgggtattcgttactgcgttagctcctaaacacttaattggattggcaggtggaatatttaacggatgtggggctttatcttcaatagtgatcccaattgtaattggtattctagtttctaatggtaatttttcttcagccttggtattcatagcagcaattgctttgctgggcgcgctttcttacatttttgtcgtcggtaaaatcgagttaaaagattaattatttagcatattagacttaaaaagcaggacctgatgtttataacattggtctgcttttttgttgtctatattgcattattttatgagtgttaattattaaaagcagtaatccaatatgtaattcaatatgctttttttgttactaatgagaaatttatatctttgttacaataataatttgactatcagtggaaaaataactgttgtacttgtaataatggagggaattttatagtatcttttaattttcaaattacagaataacggtatgatagacttatatacgtttttatttcaaataaaaaatataacgcctgtatttacatataacaagacaaggccttaaaaacaaaaaataacgatatatcggcataaaacacctatgaaagcgttgacataaactcgacgacagactatagtgtgggtatggttgttatatcgatataacaagttggtgaaagatatgagaaaacaaccattctggcaatataaacaaattagtgaagaattgatacagcaaattgaaagcggagaatttgcaatcaattctaaacttccgtcagaaaaagaactgtgtaatcagtatgacgtcagcagaattacagttcgtaaagctttagcagaattggaagaaaagggatatataacaaggcgccaaggccaaggtagctttgtaaaaaaacgtgatgcgtatgcggattcggaagtaagctttattgacaataacagtgaggatctcagaagattagggcattctgtttacatcgagttgcacgaattttctattctagcagatggagaagaaccaaatattagaaaactgatgaaagcaaagaatagcgattacttatatcgtattaatcaagtttatatatctgatagaaaaccgattattcagcgggaaacatttataatatttgaagattttcctatgattacttcggcagaacttgaaaatgctgaaattattccattacttactcgtaaatttaatttgaatcctaatttattgcaccatgaaattgatacagaagttgaaagtatccctcctaggttgcatggaataccaagtgcagcccctagagaatcttatgttaaagcaataactacgtacgtgaatgaggataatcgcattacttatatgagtacggccatttcaccagcatcatctcatgtattttttgtgcgacataaggaggaacatactatgacagaaccacatattttacttacaagaatagataatcgcttagtacatggacaagtcggagttacctggactaaaaccttaggtgctaatttaatactagttgcgaatgacgaagtagcaacagacgatttgcaacaaaaattaatgaagagtactgcggattcatcaggagctcaaattaggttttttagtttacaaaaaactattaacgtgattcaaaaagcagcagatcgacaaaaaatttttattgttgtaaaaactccagaagacgcattaacgctaattgacgggggagtgcccattaaagaactgaatgtaggaaatatgcattttgcgcctggtaaagaggagattactaaaaaggtttatgtagatcaaaatgataaaaatactcttacagagatagttcaaaaggacgttaatgtatatatacaagatgttccaggggatcataagacgaaaattaatttttaagattgctcaattaggagggctatgcgatgtcaattactctaactcagggtcttatgttatccatatttgcagttatagcaggtcttgattcgtggctagaggttttatatatctttaggccaatcataagttgtacagtagctggttttatacttggagtaccaactttaggaataatagctggggggcttacagagcttacttttgcggggttaaccccggctggagggacgcaaccgcctaatccagcagtttgtggaattatgacagtagttattgcatatactgcaaaagttgctcctgctactgcggtagggctgtctttgccttttgcaatgcttatgcaatatattttattaatgtgttattcgttattttcggtttttatgccggtaatggataaggcagctgcgaatgcagatacaaaaaagtttggttctattccgtatcttattatgacaattgtgggaattttattttttgtagtaatctttttgtcagcttatgcagctcagggcccaatgcaagcattagtgaaagccatgccactatggttaatccatgtttttgaattgtctggaagcgctttaccggctgtgggatttgcaatgttgttgaaagtacttttaagggtggagtacctaccattcttattgctaggttttgttgtagcaagcttcattaacttttctaatgttttacctgctgctgttgtaggagttatttttgcaatgattgaattctttagggacaagaaaaataaaaagttgcaacaacaaatcgatgctatgaaagcagctgatggaggtgaagaagatggaatctagaggaaatcatggcaatattcaaaaagtaaccaataaagacataactaaacttgctattcgctcatcgttgcttcaagcagccttttcttatgaacgaatgcaagctgggggatgggcttgggcgcaagtaccaatatggaagaaaatatttggtaatgataaaaagggtttagctgatgcaatggccgataacatggaattcattaatacttcaccgccgctagtttcaattttaatgggacttttaacgagtttagaagaaaaaagagttgatcgacaaacgattcgcgggttaaaaaacggattgtttggaccaatggcaggtataggtgatgcaatatattggtttactttaatgccgattgttggtggaatagcagcttcatttgcatccaagggaaatatcttaggacccattctgtttttcattgtgtatttagcgatatttttatgccgaattccatttgcgcatttaggatataaccttggtgttaaggctattgacgttattcaagataattctgaaattatcgctcgagttgcgacgattatgggtttaactgtaattggagcattaattagctcgtatgtttcgctatcacttagtgtaaaaattggaaccgtatcattgcaaaaagactttctagataaaatatttcctaatatcttacctttaggatttacgttctttctttattggttactaaaaaagaaagtatctcccattgtacttattgcagtagtatttgtactttgtattttgtgttcattttttaatattatgtaagtgaggcggtacgagtgattaaaacaattattactggacacggaaattttgctactggtttgaaaagcgctcttgagcttctttctggagaacataaagaaataatggcaatcgattttacagaaacaatgagtgaaaaagatttggctgttgaactagaaaacgtatctaagggaaatgtagcaatattgtattttacggattttgctggaggtaccccatttaaggaagcagcgaaaatttcggttcttaacaaaaaaattgaagttgtttcgggatgcaaccttaacgcgttactagaatcaatttttaaagaatacgatagtgtaaaagcatacgctcaagatcttgttaaaatcactaaggatacggcaaagttagcagactttagtgagccgatttcaactaaaaattttgcggaagatggtatttaaaataaattaataaacttaaaaagcaggactccaccttaaacacggagacctgctttttagtataaaaattatttatttaaatggacatccaaaacaaactgactttgatcaccaataaatttagaaattgaatattcaaaagcccggccacgttggtcataggcggtttgtttgattacaaaaagagggctagcaactttaacgccaagaatactagcagcttcttcatcagcagcttcagcatagacaattctttgagcatccgttaactgtaattttgctttgctgcctaagtagtcataaatggatccttgaatgattttttcgtctaatggagcgatgctgactggcatgagggtgtgctcaaagctgtatttttctccattaattaatcgaagacgcttaatttcataaacaggttcattaccctttatttgtaaatttttttgttcctctttagatggcaaacgggcatcaaaatgcaaaattttactagttattttttggtcacgatgagaataagttacacctacgggtaagtcaaggggtaacaattcaccagactgattattcatcctttggcggacaaaggtgccggatccttgcttgctaaatactaatccttcttcctctagcaaatgaatagatttttttaaggtgatccgggaaatgtcatatttattagctaactcatcttgggtaggcaaagcatggccagcacgatagtgattagttaagatgtctcgtttaatgtctgagtagacctcacgatatctgaacataaagataaacctcttatttaatatttgtatatacatattaacgataaaaatattatttgtatacatttttgtttaaaatttgtatttacaaattaatgaattaactttaatataataggtgaaatgaaagcgcttgatttcgaaaaacaatacaaggagaaaactgttatgaaattcaaacttgagtcaattcaagaaccattactgaaagtttcttcatgggtagagtggaataccatcttacaagcaattaaaaatgcgtttgttcgaacaattccgtttaccgttgtcggatcattttcaaacttaattaaaatgcagattgacgcgttaatcaaggctaagcacctagataacgttattttgaccaatataagcaatcttttcgggtacctaggtacggcaaccttagggattgtcgctttaattgtggtattttcatcggcttattcctatgcggtggaattaaaacgggattcgcgtaatgacaacttaaatccaattattgctactttgctagcattagcagcatattttgttatggtacctaataacgttaattttttagatactaaggcaaaggtgatcgagggtttttcgacatcattctttagttacgaagggatgtttacggggctaattgtcggtatgatttcggtagctttgttcgcaaagtttgctcggagcaagttcaccattaaaatgcctggcaacgttcctcaaaacgtttttgactcctttctttcattaattcctatttcagaagttttgttagtatttggcgttttacggattgtaattcagtctttaggttacgtttctttagtccaaatgatttccgaagttttgattaagccattattaaccgtcggaaccggattaccagcaattattatcgtaattttattggaacaaatcttatggttcttaggtctgcatggtttcaatattgtctggggtgtgggtttcagcgttttggttgccacttttcttacaaaacgtcgctgaatttgctaaaactcaaagttttgcaggcatctccattgcaccaaataccatgactaacgtttacgcaatgataggtggatcaggggcaacctttggtttaattattgcgatgttaattttcactcgtaaaggtgaaaaagaacgggaggttgcaaaattagccttaattcctggctgctttggaattaacgaaccggttatttttggtttgccgattgtcttgaacccgttgatgttcattccgtggattttagttccaattattaatgcagtaattgcgtacgtagttacggcaattggctgggtagtacctttagtagtgttaaattcaggaaacgaaccaatttttattagtacttgggtcctaggtgcctttcatttcagtcccgtagtattaacgtttgtgctagtcgttttggacgtgttcttgtacgcaccatttgtaattattaaccaacgacatgaacgtgcggtggctgatcaagaattagcggtttaagtaggtaaatagagaaggagtgttggttttgaaaaaagtttacgcagttgcacatacgcattgggattttgaatggtatttttcacgtcaggaggctcgggtacaatttatctttcacatggacgatgttttcaaggcgttagctgaaaataagttggagtattacatgctagatggacagatggccattgtagatgactatttaaaaacctgtcctgaaaaaagagctacgcttgaaaagtacgtaaaagctggacgattgtttgtggggccgtggtacacccaaattgatgaaatggtaacttcgggtgagtcggcggttagaaacttacggttaggcttgaaggctagtagaaaattaggtaaatctactaaggtaggataccttccggattcatttggccagagtaaagatatgccgaaaatatataatggttttggcattaaagacgccgtgttttggcgaggacttccagcggaccaaaaagttagatatttttactggacgagtgaagatggttcaaaagtgctgacggctaatatcaaaaatgggtactatgcgggcgtagacttagttgaaaaagataactttaaggagttaatgcaaaacatttctacagatactgacgtagaagatttggttttaccaattgggggcgaccaacgagcggtagattttaatttgaagaaacgcttaaagttggccaatcgagaattagctggagaatatgaaatcattgaaagcaactatccggaatactttaaagccttagaacaaagtagtgtgcttcctgaacttagcggtgagtttattgatccttcagtgtcaaaaattcatcgaggaatttattcttctcgttatgatcttaaacaaatctatgatgagctagagcaattgatgatttaccaggttgaaccactttcagcaatttcccaccaacagggtatggaagttaagcaaggattaattgatgagatttggcaaataattgctaaagggcaagcgcatgatagttcgggaggaagcaatagtgataaaactaaccgagatatttataatcgtgcggtagaagctcagcaacttgcacgttccttaaaagactatttattacgaaaattaagtgtttcagtgaagaacggggacgacttattcttatggaacccgttgccaatgtcagtagacgaagtccgggagttagaggtcagcactacgaccccgtcttttgaaattatatctcaagatggcaaaatagattttgatctaattgaacaaaagcagtgcaacgctgctaccttacggcgaaatccagcagagatggataacgaatattattacgtgagtcggatagctatgagagtgcaaattaaggctaccgactggactagttttagaattaaagaaggcaccgccggtaaagaaattttagctacttcggttactaatgaaattcaaaatgaaaaataccagatagaatttgaaaatgggcagttaaacataactgacaaactaaatcattgtacctatacaaatgcattaagctttgaagacggcggcgacgaaggagatacgtacgattattcgcctgcatacaaagattggattatcaacttaggatttgcgaatgcaacaattactaccaaagtaggaaagcaaacgcaaataatgcttttggagggcacgtggcacgtcccttatgatttgcaagaacgagccgcaaaaaaaagtaacggagctattacttaccgaataaagttgcagctagatcaaggtggagatttaataaaatttaagatgaatgttaataaccaaatacttgatcaccggcttcgtttggtgatgaacacgggggtaaaagcccaaaatacttttgcagacacccaatttggcgttgcccaacgtccagtaattgaccctaaaatggataattggcaagcaattggataccgggaagaacctacggcattaagaccgatgcttcactttgctaatgttcacgatagagaaaacagtttttcgttcattactgctggtatgcgagaattccaagcaattggtgaccaattcgataaattagcagttacgctttttcgtggtgtaggtttcttaggccgaccagacttaaaacggcgccctggagatgcttctggtttagtgatgaaatcagtagctacccccgatagccagttgatgggcgagcaaagtttccaaggtgcgattgtaattactcacgattgggatccacgacaattgcaatgtatgcatctgcaagtatcgcaatctggtttgtattaccagcgccaagtaattaaccgatttactactccattgcaatactttgcggttaatgagcttgctaatgaggttaaacatcggccaatcgtcaagattaacaatttaaaagttacattaagcagttttcaaacgtcggtagatcagacaggatatgaattacgattacataatcctacgcaacaaaccgtggctaacccaggaaatctgcaatttacgcagaacgttaacgtatctttgatggatctaaaaggtgaggtccaacaaacagtagcaaacgcggtgaaaaactattcgttaccgaagtttaaaccaggggaaattcggactatgggactgtttcctatcggagaaataattggtggtgattgagaataatggaagagcacatgttcattgaccaaacaaaattaattaaacaagttagaaattacgctgaaaaaattagtttaaccaacgctaaaactacggcaatgtttaaaaatgcgattattgacacaatttctaacactgtcgaagtgcaagatgaccgcgtttttattgcgacgggtgatattccggcaatgtggttaagggattccacttttcaagtgttaccttatttaagcattagtgaagacatcccggatttaaagggcttaattcacggcgtgattaatcaacaactagattatgtgaatcacgatccttacgcgaatgcgtttaacaaaaccgcttcgggagcacattttaatcctgatcattctaatgtcagaatttctgatttggtttgggaacgtaaatttgaaattgattccctatgtgcgccactactactagcagttcgattatatgaagatacgggatatgcgcaacattttacagactatttttggcaaaccgtagatttgattgtcgatacctttattaaagagcagcaccatgaacattctgagtatttctttgaaagagacgttggtccagcctcggacacgttaagcaatgcaggtagagggactagaattggttatacagggatggtctggtccggttttcgaccaagtgatgacgcatgtaaatacgggtatttcgtgccaggaaacatgatgattgtgacggtaattgaacacctgttaaaaatcatgaaggagcaacgaatagatgatgcagctttatcgactaaaatgaatcgcttagctaatgaagttagaaacggaattgaacgttatggagttgttgaactaccggacggggctcgaatgtttgcttatgaagttgacggattgggtaactataatttaatggatgatgccaacgtccctagtttgctagcaatcccctttattggttatacagatgaacgggatgctgtgtacgttaatacgcgaaagtttattttatcttctaataatccctattattatcaagggacgattttgtcgggaattggtagtccgcatacaccccaaaattatgtatggccaatcgcattagcaatggaggggttaacgactagtgatttaaacttgattaccgctaagctgaacgtgattagtcaaacggatgcgaataccaaccagtgccacgaaggaatcgacgtaaacaatcctgataaatacactcgggaatggttttcatgggcaaacatgactttttgtcagttggcgttccactacttgaaggtgaaaggagagctgttttagttagggtgtattaaaaatataaatcactaaaataatatgtatttttataaaagctggaattcatttccagctttttttgcgcaaaaaattattaattagagtgcaaaagttgcagactaacgactgctataacttgtcttgttagcgttttcataaaaagtaaaatgaagtcatagcataaggaagggaggaaacactagtgttaaatgaattgttgaccaaagatacgattcagtaccgagatattgaccaccttaattggcaagaggcgattaaggttgcagcaatgccactaattaagaacggaagcattttacctcggtacgttgaatctatgattaagatttctctgaaagaaggaccgtactttaacattggaccagaagtcgtcttggctcatgctagaccgactgatggttctaatgggattgcattggcactcttaaaaactaaaaaggacgtttgtttaattaatgatcaacatcctgcaaagttatggtttgttttagctgcaaatgataaccaaagccatttgatggtaattaaggagttgatgcaattattaacagataaaaagcgggttgatttattactcaacgctgaaaataaacaaagtattgaaaaaattattgtcgaaggagtaggaaaatgaagattttagcagtttgtcaaagcggattaggaagtagctttatggtgcaaatgaatatccaacagatattaagcgacgagaaggtagatgaagaaattcaagttgatcatgcagatgtgggcagtgtgactgcagacgcagctgattacttttttgtcgaaactactttgaaaagtgcgctaggtagtcttccagaagataagattattcttttaaatagcctgattgatcaagatgaaattagggaaaaggttaatgaaatactagataaaaataatatccaacatggttaatacaaaataaagaaggtggcattaatgaaagcgattctaaatctatttgtagcgattgcgacgcaaccagcaattttagtcgcattaattgcgatgacaggtctattgctacaaaagaaaaaagcaactgaagtggtccaaggaactatcaaaacttttgctggatttttggtcctgattggtggttcaggaattttaagtaattcgttggcgccgtttgcaagtatgtttcaatcggcccttcacgtacaaggggtggtgccaagtaatgaagcagttgtagcgattgcgttagttaagtatggatcaacaacggcgctcattatgttagtaggaatgattataaatattctcttagcacggttcacccggtttaagtacatttttttaactggacaagcaatgctttatgtttcttgtttaactgcggtaattttaatttcagctaatttaggaaatggttggcaaacggttatcttaggtggcatttttgaagggactttattaacgattaccccagcactttgccaaccctttatgagaaaaatcaccggtggtgacacagttgcaatggggcacaccgggaatattggatacgcaactgcaggattggtcggaaaaatttttggcaataaagaaaagagtacagaagacttaaatattcctaaaggactaagttttttaagagattcaacagtttcaattactttattgatggggattgtgtacattgctttagctattgtagcaggtccgcactttgtggaaactaagctaagtggcgggactaattacattatttatgcattagtgcaagcgggaacttttgcagctggatttgtagtggtattacaaggtgttcggatgattttagctgaaattgttccagcctttcaagggattgccaaaagcttagtacccaattctaaacccgcactagatgttccaattatttttccttacgcaccaaatgctgtattaattggcttttttgtaagctttattgtaggtaccttaagcatgtttgtgatgattgccatgaaaaccacggtaattattccaggagtggttggccatttcttttgtggagcagcagcagcaatttacggtaattcagaaggtggacggcgaggtgcaattttaggtgctactgtaaacggtttaattattagttggttaccgttattgattttaccagtactgggctctttaaaattggcggcatctacttttgcagacacagattatttagtacccggaattctattaggaaaactaggtagcttaggaacgatggcagtagttactggaattattttatttttcttaatagtactagtaaccagcgtaattttaaatcagcgagataagacatcagattaaaggattgttgggagaagaagaaagtgtttactaaaaaagatattgatgcggttaacgcaattcgttttctaagcgcagacatgattgaaaaggcgcaaagcggacacccaggtttgccgattgatgcggcacccatggcgtatacattatgggagaagttcttacaatttaacccacaagatccaaaatggattaatcgggatcgctttgttctaagcgcgggccatggatcggcaatgctttatagtttattgcatttgaatggctttgatttaccgctaactgaattgaaaaagttccggcagctcggttctagaactccaggacatccggaatatgggatgacggccggtgtagatgcaaccaccggcccgttaggccaaggcttagggatggcagtcgggatggcaatggcagaacgccacttagcagcgttggctaatcgcccaggttacccagttttcaaccacttcacgtatgctttagttggtgatggggatctaatggaaggggttagtcaggaagctattaacattgcaggccaaaaacagctcaataaattaattgttttgtacgattctaatgacgtttcgcttgatggacctttgagtttaagtgctaacgaaaacgtcgcgcagcgttttaaagctgctaactggaattaccaaaaagttaccgacggcaatgatctggctgggttgcaacaagcgttacagcaagcccaaactagcgaccgaccaaccttgattgaagttaaaacgataatcggatatggtaccccggaaagcgggacgaataaggtacatggaaatgccttaggaaaggctaatttggcagcgatgcgccaattttatcattggcaagcgacgccgtttgagattgccccagaaatttaccaacattatcaagaacaggtagctaaaaagcaaacggcctaccaagcctggcaaacgatgttccaagaatatcaaacagagtttccagaagtttaccgccaatttcaagatgcgcgcttagatacgaccaagcttaatttagatgacccggcatggcaggagcccatggcaactcgaacgagcaattctaaaattatgcaacaggttgccgaccagaacgtgcaattatggggcggctcagcagatttgtattcttcaaataatactcaccttgatgattcaaaggcgtttgatgcgttgcatcccgaacaacgcaacgtttatttcggggtgcgcgaatttggcatggcaactgcggttaacgggattaacttacatggcaacacccgggcgtttgggagcacgttctttgtatttagtgattatctcaaagcagcgattcgcttagcggcgatccagcagattccagcagtatacattttcacgcacgactcgattgcggtcggcgaagacggaccaactcatgagccgattgaacagctagccggattacgatccattcctaacgtgacggtgattcgcccagccgatgcgcacgaagtactgggcgcttggcaaaagattggccaaattactgatcagccaacggtactagtgttgacccgccaaaaagtgccattattagtgcaaacgcaggctgataaagtggccttcggcggctatacactttcgccagctgccaccgccaatccggacggaatcttggttgcaacgggttcagaagtcgccttagctctacaggcacaacaaaaactcgcccaagaaaaattgaacgtggcagtagtttccatgccgagcgtcgagcttttccaagctcaaagtccggattatcaagctcaagttcttccaccaaacgtgaaggtaaagctaggacttgaaatgggcagtcgcaatggtttagccacagtggcgagcgcggtaatcggaattgatcactttggggcaagcgggaacggcacgaaagtagttcaacaagcaggcttcacggtagataacattgtggaacaatttaaagcaaaattagcagaggcggaagtgaaatgatggatgtaaatgatttaactattaaggtttatgaagacggcgcggaaattgagaaaatgcgagctgctagtcaacaggcgttcgttaagggctttactacgaacccttcgctattaaaacaagcgggagtgactgattatttagcttttgctcgccaagtggtggcagaatttccaaagcaggagttttctttcgaagtttttagtaacgaaccgcaagaaatgttgcgggaagctcaaattttacatgatttaggtccccgagtgtatgtaaaagtaccgattattactacaaccggagaatccactgcggacgtgattaaagagctatcggcagcgcatattaacttaaacattacggcaatcaccacggtagaacaggttgaagttgccgagcgtaatttagcaccaggcacccacaacttaatttccatttttgtgggacgggtagctgacgctggaattgatccgcatcatttgattgaaagcagtgtagaaattacgaagtctcacccagaagcatccttgttatgggcaagtacgcgagaagtgtacaacgtatttgaagcacaacaaatgggggtggatattattacggtgccaccagctttaattacgaagttaagtaaaacgggtaaagcagctttagaaatttcagtggatacggttaaaggtttccaacgggatattgaggaatcaggattgtcaattttatagccagatttttttctcagacattgtattaactattgtctgagattttgtgtatgttaattagtgaatagcatgggtgaatagcatgggtgaatatatgttggaattaaataattcggaaactaaagtattagaagcacttttaaaaaacaatgtcttgtattcaataaaagatttagcaaccgaaactaaattatcaaatcgagcaatatattacaacgttgctaacctttcaaaaaagctgatggtaaataatattgaaccgccgcgcaatattcgcggaaggggatattatttgcctgaggaaagtaagcgtcttttaaaaaataattattacagtgataaattactaattctagacgcccattctcgtcgaatcttcttgatttttttaatgttaactgagtcaagtttcaatacattagctaagatggcggagattttagaagtttctaggaatactattgtacatgatcaaaagataattacagtttttttgaaaaagtaccatttaacggtgattggcaaccgaaagggtcattttatttcaggaaatgaagtagatattcggtattttttacaaaacaatagcgtaaagattgcaactgttttagcagaagtaagtaagcaaaagggcgactttgacgaaattcgttccataatgaacttaagaagtgtcattgaaagttggctggaaagtattgaacagcgtagttttttaaattttactgacgatgggaaaaaacatctagaaaatttttatatgctagttttaaatcgaatcttacgaggacacatattacaatcaggtgagatgtttgcgtctggaatggattaccatcatttacgaaaacaaaatgaatttatgatggcaaaagaattgctaacaaaattaggattggacttaagagcaaagtatgaagaagaggtctattttttagaaagtatgttattagggacgcctaaaaatgagattggttttagtggagaaagcgatgttaaaaatacgctaaagaaggttactaaagagatagtagataattttaagaagctaagcggaatgaattcaaataatgaaagccaattactaaacgatctttacacgcatttagtttcaactttttaccgtgttaaatataaccatcaatatcgagatggattagttacacagataaaaagtaagtattttaacgtttacacatataccaaaatgtctttacaaccatttgaaaaattaaatgttggacatttgaacgaaaatgaaatttcgttgattgcaatttattttggttcacagatggttaggcaagctaagcaaggtacggttcttttagtttgttctgcggggttgggtacttcgagactgcttaaagaagaaatacttgctcattttcctgacgttaatgtcatcggtccgattactaaaagtgaatataacaatatccaaactgatgattatccactcataattacaactacccctttaaatagtcagccaagtaataaagtgattctactttctccaattctaacgcagagagatttgattttattgcaaaagttatttgtagagagagggattttgcaaactaactctaagtttaatgaaagcaagtttgcggcactgatggatgttattaatgacacagcaattattcgcgatccagtaaaattaagtgaggggatcaaagaaattttagcaacggatactgagaaaagacaaaagattattaaaaatacttacccaaaactaagtgaactaattactaaagacactactagctttgttgatggtcaggacttaaattggcaagctgctattgagttagcagctaaaccactaagtaaaaataatcaaataagccatacctatgttgaagccatgattaataatgttatccaaaatggtccctatattaacattggcagaatggtggcatttgcacatgctaaaactgaagatggggtaaatagcttaggaatgtctctcttgcatctaaaagaaccgatttcgttagttgacaaacaacatccgattaaattggtttttgttttagcagctgttgaccaagaatcacatgttaatgcaatggctgaattggcagcacttctgagggacgaggagaaactagatcgattgcttgacgctaaaaattttgaggagattgcacagattattcgtagtgtggaaaattcttaaaagaataggatacgtttaagctgttttaaatgtccaaagaaatcatttcgtttaacgacgaactggtttctttttgatttcaaatgaaaattaaatgaagatttaccttcttgaatgtcgccaattccaatatttaatgataaagttttacttgagtgttactgcggttatgtattaattggagtacattagtaaagaagataatttgtatatagtgaaaatgagtaactaagagggggtagcccatggcagcaacgttaaaggatattgcggatcgagttggagtatcgttagcaaccgtgtcacgagtgctaaataaagatacgtcactttcagtcggcaatgaaacgagacaacgaattttagacgccgccgaggcattacattattcaaaaaacaaacggcatactaattcaaccgccagaaaacgcctagcgattgttcagtggtattcggaaacggaagaacaagacgacttgtattacatgtcgattaggatgggaattgaacaacgcggacaagataatcattttgaagtaacccgaatcttccaaaacaatctccaagaattgggaccggattttgatgcagtaattgcggtgggtaaatttagcgagccacaggttaaagaacttgccgccgttacgggaaacttggtttttgtagatgatgatcaatttgcggctggtttcgatagcgtaattactgattttcagttggcgacagaaagagtggtcgactatttttggcaacgcggtattaaggacattggaattattcatggtgctgaaatgactaccgatcataagttgaccgtgaccgatcggcgaatgctgggattccaggccgcaatggagaagcggggtgcttttgagcctaaatttgtatttgaaggtgactatactagcgattctggtttcaaaatgatgcaaaaggcaatcgacacgcttggtgatcaacttcccgcggctttttttgtggctaatgatcccatggcggcgggtgccttgaaagcacttcaggccaatggaattgaagtgccaaaacgggtcaagatttttagctttaacaatacttcgctggcaacgtatgtttatcccgagttaagtgcagtcaatgtggataccgaattaatgggggccacggcggtgaatttagtgatgagtcgcttgacgggtcgcacaactactcaacgggttgaactcgatacaaaactagttgaacgggctagtacaaaataacttttcatggaaaatatttgtggaagtcgcatcgttattagataagctgatctagtaattgtgggactttttattttaactaaaatatttactcaatctacagcacaatttggtatactgaacttgaaagcggtttaattaatttggaggtgtcacaatattggaaactaaaaaagaagtatttgatcaatttgagggtcaagatgtaatgcgctatacgttaatcaacgaccaacaaacgcggatttcagttttgagctatggtggaacgtggcaagaatttgtggttaatgaaaatggtgttgagcgcccattaatttggggattggatagcatggcggattatcaacgagttggttactgcctttgccaatcagttggacgagttgcgggacgcattggcggggctaaatttaaaattgatggccaagaatatcaagttgatatgaatgaacaaacacactcgctacatggcggtaatcacggttttaatacgttaaattttgccggaaaatttagtaagagtgccgatagtgtcagcgtggttttatcgaagcacattaaagcaactgacgataattatccggggaacctcgatgtagaaatcaaatttactttagataaccaaaatcaagttacgatcgccttcacgggggatacggacgctgccaccctgtttaatcctaccaatcatgtttactggaataccacggacgaccgggaaagtttaggtaaacaatggttacaaattacgagcgcagcccatcttgagtttgaccaagaaaaggtgcctaccggtaaaaaaattgcagttaaggacacttgcttataactttaaccaacctaagtcggttgaaaaggctttgcaacaattaaaaaacgaaaacggcgggattgaatttgatgatgcttacgaagttaacccgagcgcgaccactccaattgcaatgattggagacactgatggtaaacggcaaattaaactttattccgaccgcaacggtttggttatttacacggctaacccatttgacccagataaagaagctgctcatgagtacaacgctttggcgactgaagcacaaactttaccagatgcaattaaccattctgattttggcgacgttattttacgtccaggtcaaccaattactaacacgattcgttaccaatatgaacgtttgggttaaggcagggtctaattggttacccagaagtcttagttacatttaaatttgaaataattattgttttaggaacggattatctggtgcatttttaatccgttaaatttaatagggggcagtttgagaatggttaaattcttaaacagctcgctattttttttgctaaatttttagtagtcaatccctaaaaaactgtttaaaagcgcgaggtaaaactacgcaaaatatattaaaagttttgaaattaagacctgaagtggttggaaaggctgttttataaggcttggtaagggagggtggaaaatcatttcaagattaatctaataaaataattaagcaaattttactaaaaatatattgacatctcttctggaaacgattacatttagtgcatagataattaaaggagatttgatagagattatggatgcagaagttaaacaaagtaaggggcgtaagatcacttcacgactagcttactcatttggtgcatttggtcatgatgcattttatgcaacactttcaacatattttattatgtttgtaacctcccatttatttgataaaagtagtggggcacaaggtacaaagatgatcgcgtatattacgatgattatcgcggtattacgtttcgtcgaactggccattgatccgctgatcggaaatgcgattgataatactaattcacgctggggacattttaaaccgtggattgtgatcggtgggacaattggttcggttgttttagcgcttttatttaccagtttagggggattgaacacctctaacccaattttgtacttaatcgtttttgctattttatatattacgatggatgttttctattcatttaaggacgttgggttctggtcaatgattcctgccatctcgtttgattcggcagaacgtgaaaagacggcaacctatgctcgggttggttccaatatcggacaaaacatcgttggtgtcgtcgttatgccaatcgttttaatgttttcaacgaaggctaacagcggccagggtgataatcgtggctggatggcctttgggattatcatcgctgcggttgccttaatttcagcctttgcggtagctattggaactaaagaaaacgattcggaattacgtaaaaatactgaaaaaactacgttcaaagaagttttcaaagtgttggcccgtaacgaccagttgatgtggttatctttaacttacggaatttacactgccggaatggcaattaccaactcacttgaactttattactttacttacattttaggcgacgcttcgaagtttacgttgcttggttcgttaaatgccattattggggtcttcgccgtattggcctttcctccattggcaaagaaatttagccgtcggaaggttttcttcttagcaatttcagttatggtgattgcgttggcaatgtttgcctttgcgggtcaatcattaccaatgattttaaccgctgccgtgctattctatattccacaaccactgattttcttggttgttttgatggtactcagtgattctgttgaatacggacaattgaaatttggtcaccgggatgaatcgttgacgttatccgtgcggccattacttgataaattaggtggagctatttcaaacggtgtcgttggtttaacagctgtttgggctggaatgactgctggcgcaacagctggtgacgttacttcccatggacaagcaatttttaaattgatgatgcttggagttcctgcagtaatgattttaactggagcattcatcttctttaagaaagttaagttagatgaaaagatgcacgcccaaatcgttgatgaactcgaaaaaacttggtcaaaacatttggaaacggatgaaactcctgcagaaatcgaaacaaactctgaagtaaccatttaccatagtcctgttgctgggaaactgatcagcttagatgaagttgcagacaagacctttgccagcggtagcatgggtaagggatttgcaattcaaccaacggacggtcgggttttggcgccgtttgatggcgaagtggttgcaaccttcccaactcggcacgcaattggccttcgctctgatcaagggattctaaccttaattcatatcggaattggtaccgttaacatgcgaggaactggtttcgttcagtacgttgaagaaggcgatcacgttaaacaaggcgaagagttgattgaattctggcaaccggcaattaaaaaagctgggattgatgataccgtaatggtagtcatcaccaacaaagaaatgcctgaatttgagtatcttaaatacatgggcaaccttgttcaagataatgaaaacgttttgaagttatcgaatacggaattaccggattaaattttagttataaaaagaacttttccatttgaggaagttcttttttgtatgtcccaaagacgctgtaaaaaatatttcgatatatagatttggtagggaccaaacgtgggacaaaagttaatttgttccggttagctgcaaaatagccattatgccagtttcgggcataatggctatttttactttaacgttcgcaaactaccgacttttatttagaaatggatattgaaatcgaaatcaatgtcttggtcagcgggaatatggtaacgttgttcgacatccgcaccccaactgtcgatcccaccgacaccgcgaactgcgccgtatatggagagcacggtgcgccttggtaatggaagctcttcgatgtacgtggcattttcaagttctgcggcggtatacggtaaacaactaaaggcaaatggctttttggtttggctaaaagtcaagctaaatggttgaaaatcgggatctgcattgttttgggtggttgagcgggtcacggttagttgactggtttgcatgtgcatcccgcattcttgaggcgccaggtagggggtgactggtaatccgtcaacgtgaaaatgcccatgcgttgcgcctgctaaccggtcgggataggtttctcccgaaagccccgtataatcaaaactagtggctgtcgtgggcataataaagcgtagaccaaacgcgggtagttcaggcaaatctgcctggccggtgaaatgaaccgccacgttaatattaccgtcactagtaacggtgtaagtgatcgttaccgaagtacttggtacggtcggcgtgaccaaatggtaggttaaggcaacctcatttgcgtactcccggttagtgtaacgattattaaacggtgcgatgggcaagggttgtagcgcctggacatcaaccgctaattaaattttttgacaagtggtgaaccggtcggctgcgtaccattgagctgccttaacgtcaaaaccatttccacggtcgttatcagtagttgcccgccagaatagcggagttggggtgcgatagagccattctttattatcaaccactaaagactcgaggcccccgcgctcgtagctaaaaagatagtgaaaattggggccggccactcctaaactgccgtcaccatatattacgcgtaattggctatttgtgtaatccataatagtatttcacctcctgcattgctggtttgggtgttcgatcagcaaacaataatccatctcccgaaaactcatagtcagaatggcgttcatcgaagtcaccgccgtaacgaaggacttcttgattggttaccggatcgtgaaccaagagggcttggtcaatgaaatcccaaataaacccgccttggtacattggatactgatcaattaagtcgttatatgattgcatgccacccaaagaattacccatatcatgcatgtattcacagtttaggaagggtttatccgggttattttctaggtaacgcgcaatgttagctggggtttcgtacatccgactttccacgtcagaaatgcgatcccgaaattcgggcgcccggaccaccccttcgtaatgaactagacgcgaagaatcgtgttctttatagaaagcttgcatggctgcaatgtcttctcccgcaaaggattcgttaccgagggaccagaaaatgattgatggatgatttttaaaccattcgtaattagaacgggcacggtcaaccacggctgctaaccagtggggattatcaccgggaacgttataagaaggctccactgcgcccattttttgccaggagccgtgagattccaaattattttcggccatcacgtaaagcccggcttcgtcgcaaaggtggtaccaggaaagctggtccgggtaatggcaggttcgaacagcgttgatgttgttatccagcataatctgaatatccttgcgcatgtcatccagtgaaatgactcgaccactgtgagcattccattcgtgacggttaaccccgttgagaattagacggtggttgttaacgtaaataaccttgtcctcgcgcaattccactttccgaaagccgaattgatagggaaccacttctaagagttggtgctgatcatcataaactttaatcagtaattgatataaagtcggtgaggttggtgaccagagttttaagttgttgaaggcaatctttttaaataaaactttaccagttcccgtttgggtttgcgttgctagaagctgttgatcttgatcagtcacgtttaactctaaagtagcgttagtgccagaaacagtagccttaaccgtaaggatgccactcttaaaatcggcgttcacctcgggtttaagatctaaatcaacaatgtgcgcatcgggaagggcaagtaaattaacgtcccggaaaatcccggaaaaacggtacatgtcttggtcttcgataaaggaagcggtactccgtttataaacgcgcacggccaggagattatcacgatcttgaacgtaaggggttaaatcgaattcagaaggggtaaaactgtcttcagcatacccaataaaatgcccgtttaaccaaacgtagagggcttcctcgaccccttgaaattgaatgataacccggtgatttttaaaagaatcgtcaaggtcaaattttttcaggtatgagccaacgctgttgtcgctcgcatcactaaataagccgggttctagttgatcttggttaagcgtgtacggcgggcgccgatatattttaccctcccagggatacaaggtattaatatattggatctggctgtaacctgctaattcgatgtgtccggggacttgaatggtatcaaagtcggcatcgtcaaaattaggtgaatagaactggagcgggcgttcggatggcgtcgaagcaaaatggaaccgccaagtcccgttaaggcttttcacaaagctactgccgcgattaagttcagctaaattgcggtagtaatgatgatcgctgtgggcgggaagttggttcacccgaaagacctcaggatcatcaagccattggaggtttgcttgcataataaaactcctttcgtaatctaaaataaaacgcttacaacaaaatgatagaacataaagttaagtttgtatacatagttttagttaaattttaaccaaaaataatagtttcttggggttcaaaaaatgacttcatcggaaaaattggagttattggtgtttttgcgtaaaaacgctaccattttcgtttataaagggttaagcgggtgttgacaagtgacctttaaagctatatattcaagttaataaaattttagtaaaatacggaggatacatattatgaacgcaaccgacttaaagaaagaattttccgaaatttttgacaccaaacctgaaagggttttcttctccccgggacggattaacttaattggtgaacacactgactacaatggtggtcacgtattcccatgcgcaatcacaatcggaacttatggtgtttacgcaccccggacggatagtacggtcagaatgtactcggctaatattccggattcaggagtagtaacgtttgacgtgaataacttggaatatgacaaagcagcgggttggacgaattatccaaaagggatgatgaacgaactggttaaaacgggagctaagtttgaccacggatttgacctttacgtacacggcaacatgccagacggcgcaggtttatcttcctcagcttccattgaattattgaccggagctattttaaacactgcttttaatctaggcgttagccaattagacttagttaaaattggccaaaagtgtgaaaataactacgtaggggttaactctggaattatggaccaattcgcagttggaatgggtaagcaagaacaagcgattttactggacactaataccttagattattcatacgctccagttaagttaggcaatcacgtaatcgtaattatgaatacgaacaaacgtcgtgaacttgcggactctaaatacaacgaacgccgttcagaatgtgaagaagcgttgcgtcgtttgcaaactaagctagacatcaactctttaggtgacttaacaaatgatgaatttgacgaagcagcttacctaattaacgatgaaactttaatcaaacgtgctcgtcacgccgtttctgaaaatcaaagaaccattcgggcagctaaggcgttggcagacgacgatttgaagacgtttggtgacttagttacggcttctcacgtttcactccactttgattacgaagtaactggtaaggaactagatactttggcagaagcagcctggaaacaacccggcgtacttggagctcggatgaccggagctggttttggtggttgtggtattgcaatcgtggaaaaagaccaagtagaagcttttaaggaaaacgtgggcaaaatttatcgcgataaaatcggctacgacgctgacttctatattgcagaagttgccgatggacctaaagaactttaatactaaacgaattttaagtgacgattacgcattgagagattgaggaggaattagaatggctgtcttagttttaggtggtgctggttatattggctcacatgcagttgatcaattgattacgaagggttacgacgtggcggtggttgacaaccttgttaccggacaccgcgcagcagtaaacgaccaggctcgtttttacgaaggagatatccgagatactgaatttatggattcagtttttactaaagaagatgtggaaggcgtgattcactttgcggccttttcagttgtcccggaatcaatgaaaaatcctttgaaatacttcgataacaatactgctggaatggtgaaacttctcgaagtaatggctaaacatggggtgaaacggattgtattttcatctactgcggcaacctatggtgaacctaagcgggtgccgatccaagaatcggatccccaagtgcctaccaatccatacggtgaaagtaagttagcgatggaaaaaattatgcattggtcagacattgccgacggaattaagtttgtcgcgttacgctacttcaacgtggcgggggctaaaccagacggtagcattggcgaagaccaccatcccgagacccatttagtaccaattattttacaagtggcagctggcgaacgcgaccagttacaaatctttggggacgattacccaactgctgacggaactaacgtgcgcgattacgttcacgtggttgacttagcaaatgctcacatcttggcattggaatatctcaaacaaggtcatgatagcgacgtatttaacttaggatcgtcaactggtttttcaaataagcagatgttggatgccgctcgtgaagtaaccggaaaagaaatccctgcagttatggcacctagacgtgcaggtgaccccagcaccttagtagccgctagcgaaaaggcccggaaagtgctcggttggcaaccgcaatatgatgacgttaaggaaattattaaaaccgcttggaattggaaagtaagtcatcccaagggttacaatgattgaggaggacaagcatcatgaatagtttagaacaatttgtccaagccgtaatcgattcaccatcgcagtacaccaacttggaccatatttatgtttataatcgtgttttaggtttggttggcgaaggtgaaccagctgaagccgttgatggacagttgacgagtttggtagatgcgttagttaagacggctatccaaaacggtaaaattgaggatactcaatcagataagagcattttagcagaccaactaatggacttggcgacgccgttgccttccgttttaaaccagcttttttgggataaatatcaggtgagtcctaaagcggctacggattatttctttaaattaagtaaagataacgactacattaaaacccgggcaatcgctaaaaacgtatcttttccggctaagacggactttgggcaacttgaaattaccattaatctctcgaaaccggaaaaggatcctaaggcgattgccgcggcccgtaaccaaccgcaaaatggctaccctttgtgtcaactatgcatgcaaaatgagggctatttaggtaggttaggttacccatcccgcagcaatcaccggattattcggatgacggtaggcggcgaaacttggggcttccaatactcaccgtacgcgtacttcaacgaacattcgattttcttagatcaagttcaccgaccaatggtgattaaccgacaaacctttgccaacttattggaaatcgttaaacagttaccacattattttgtgggcagtaatgctgatttgctaattgttgggggatcaatgttgtcacatgaacactatcaaggtggccgacatgtatttccaatgatgaaggcgccggttgctagaaccattgaattaggggtgaatggcgtagaagctggaatcgtgaagtggccaatgtcgaccattcgcttgaccagcaaagattcggttgcgctgacggatgcggccgttaaaatccataatacttggatgaattattccgatgaaagtgtggatgtcagagcgtataccgatggaacgcgtcatcatacaactactccgattgcctataaagatggggagaactacgtgatggacgtggtattgcgggataatcagacttcggcagcatttccagacggcattttccatccgcaccaagacgtacaacacattaaaaaagaaaatattggcttgattgaagtaatgggaagggcaattttaccagctcggttaaagacggaattggtagaagtggaaaagtacctgttaaatcaagtcaaccaaatggcagaaatgcataaaacttgggctgatcaattaaaagaaactacgtcgattacgccagcaaacgttactgaagtggtcaatacggccgttggtaatgttttcgcgcgggttttagctgatgccggcgttttcaaatgggatgaagctggtaaggcagcctttgctcgtttcatttccgcagttaagcaataggcccggaatggggatcgttgaacacctggtttaaacatccccacgaatctttatacgcttagcgcggtaaagtcaataaaataagaggctggaaaaaataaagcaatattttttcaaggataaaaagattcttaacaagctgttttggcgtcaatagggtcaaagcgtgcgccaaaatccagtctgttccgtttaaccaaaaaaagaccgttacgccgaatgcaggcgtaacggtctttttttgactagagcaaactacccgacatttggcgcacgctacttttaggccgtggttagattaatccttccgcaaataggccttcgcaatggcttttaagccacgccgtttaaaatcggtaaccggctcgccgttaaagtagcgaatgccgtcgacggcttcttcaatagtcatacttacggggtggttttgaatttggaaatcctccgagcggcccattaagtaatcaagggatacatcaagagcttccgcaacctgaagtaacttgtcagctcggggagcttgcgttttccaacgataaatactattaaccccaattccagcgtgttgtgcggtggttttaagattccaatttttctttagctttgcggttaatttgatccggtcgacgaggtccatcgaattcctccattctaattatcgaattcagtacttttagcgatgacaaattttgctaaaagtctgcagaataaataaaaaaatttttgcgcggactaaatccccaaatgaagggtttttagagcgttattataccaaaattattttactgaattcagtacttttttgtcaattttattatcttaagcgttgctaaagcaaacaaaattaaaatttaattaactttttaatggaaatctatttatttttgcagcgttttctggtgtaatagggtataaatatttaaggaggacaatttatggaaactacgggtaacaaccgcaattttcgttggtacaacattgctttgatttcgtttacggccgtttggggcttgaacaacgtggtcaataactttgctaatcaaggcctcgtggtcatcgtttcttggatattgatcatggcgctatattttatcccttatactttaatggttggacaactgggggctaccttccaaaacgcggaaggtggcgtttcttcttggatgaaggaactctccactagtcggtgggcttatttagcagcttggacatattggattgtgcatgtgccttacttagcccaaaaaccacaggcaattctaattggatttagctggcttttccagagtaacgggaactttgttaaccagactccgtcatacattgttcaagcactaagtttagtaatattcttaatcttcttatggatggctactaagggcgttactactctcaatcgtgtgggaagcattgcagggattggaatgtttaccatgtcgattctcttcattattttaggtttggcggcgccgtttattgaccattcgtcgattgctacggcacacatggatcaagtcagcacttatatgccaaaatttaattttaattacttcaccacgatttccatgttagtttttgcagttgggggagcggaaaaaatttccccatacgttaataagacgcgaaatccttccaaagaatttcctctaggaatgattttacttgcaatcatggtggcactttctgctgtcctaggttcgtttgcgatgggaatgatttttgacgccgaccacattcctaatgatttgatggcgaacgggtcgtatacggctttccaaattttaggaaattacttccacgtggggaacttgttgacctggatttttgcaatttccaatattttatcgacttcggcagcgctcgcaatttcagttgacgctccgttacgaatctttttaaatgacgctgataaaaactttgtgccggcaagtttgcggcggaaaaataagaacggcatcgcgattaacggttacaaattaactggaattttggtttcgatcattattatcgttcctgcattgggaatcggtggaatgaatgatttatataactggttaatgaaccttaactcggttgtaatgccaatgcgctatctctgggtattcgtagcgtacatgctattgtcgaagcaaatcaagaagttcaactccgactacgtctttgttaaaaactcgaagattggctttgcttttggattatggtgcttcttgtttacggcatttgcatgtattttaggggtgattcctaagattgactacgcagcaaatccaacaacttggtggttccaattggcaatgaacatcatcacgccgtttgttttaatcgcgttaggggtcattatgccaatgattgccaaacgacaagttaaggaagaactataaagatcacggatgatttaagaataaagctgatagttattgataactgtgttagcttggcgaaagctttgaatccgattttaaaataagggcctctcaagaattttagattctgagaggccttttttagactcaacgaccttacttttaatgctgaaaaatttgacaaatacgaacatgtgtttgtataattaacccaatatattagtgagggtgatggttatgcaaaagttaagcggaattattacttcgtcgattaaaatcattagttattcgccactcttaatgcgatttcagctgacggatcgtcggcagcaaaaatacaacatgctgatccatacgcacgcgctacggtttttccaagaagcacgtcctggatcagcgttaatagcactggtgcggcctaaccaacgtggccaaatggtggttcgccagtttacagtcttcaacgcggaagtgctggtttaaaatgaatgcggatgctagggtgattttacagcgaattcaacgatattttaaaaagattccgaacacatattatgcaattaacattgtcgacgaccggtttgacgattgttataacttctttttcattattcataaaaagaacagtcggccacattcgattcctttgcggagggtgaccccttatgatcttgaatccttgaaagaagtggtacgtgaggttcggaaagtctatcaattaacgattaagtacactggatttacaacggaacaaattcgatggttgcagtctcctaagtagtgtgatttggcggacgatttgcattagagtagcgctaatcatcttcaaaaattattcaataatgaattaatctcttcccactgtggaagagattttttagtacaggcataaaaataattattttatttggggaactgttgggtaccgaacagttttttttacgaaattttggtaaattaattgtgaaataaatatcaaaatttcgcttgaattttatcgaaaaagggggttggtggagtggatagtttaaagggcggtgagcaagggtacgcaattgagttttatggtggcaaaaaaatggggatggttcccatcgtggtttacattatcattagtgccgggttagcaatctttttccaagtgtatttgttggacctccattgaaaaatattgattacactaaactagttaacgagatttaaaaacaaaagacagttatacgaaatacctcctacctaaaaagcccccgatttttgtgaatcgggggtttattattttagatatgtataagcagaatatttatcttgacgcaaaaaaggggtacaatacaagcagaaacattgtgatgaaatgaacttgtaaagtagaaaggttgttaagtatgagatatattgttacaggtgccgacgggaagttagctggaagagttgctgaattgatgttaaaagaagttagtggtgatcagctgacgttcacttgctacaaaatggagcgcgtacccaaggataaattgaaacgttgggaagatgcgggggtgcgagtcgttgaagctaactataatgataaggaatcgatgcttaaagcctttaagggcggagatcgactctatttaatttctggtcttgacgtgggtaaacgcgttcaacaacaccgtaacgcaatcgacgcagctatcgaaatgggcgttaaacacattacctatacttcatttgttggggcgagaaatccagcgtataagcacatttttgtaacacctgaccatactgctactgaagaatatctggaaagtacaggcatcgactatactgctttacgcaacaacctgtatatggaaacattcatgacaatgcgggctatgttagcctttatgtctaacaatcggtgggtcacaactgccggggaaggtaaggccacgctagtttataaaaacgattgtgctaaggcaggggctgcttcacttcttggaaaaagtactcgcaaagtctacaacattgtaggctcagaatcagtttctattcgtcaaattgcagaaatgatcagtaagcgttcaggacaaaaaatcgaatacgtcccagctacaccagaacaatattacgattatttggaggctttagggattcctcatgatatgtctggtgacttttcaaaatcaccggcaccatttagcgcaaatgacgttgttgataatgacaaatcggttgcggacggtttgctagatgttaaatcgaacgatattgaggaattgactggtgataagcctaagacacctgaagaagtcattggtgagttcgattatatctggaaagatcacatcactaattggcgtcaaatgaaatagctctgcaatccaaattagggcaccatttttttaataatgtgcgtagattaaaggacaatgatagagagtaaaaaccgctcgactaattcggacggtttttattacgtgtttggtatgcaaaattgttcaatgattaaattattcatttaggaacagattgggagcaggaggataatctttccgtaatactcatggataactacccaaaaaaagtgccacaatcccattattaccagaggattgtgacacttttgatttatttccgtaaggttcccaaaacatctaaaaagcgaacgacgggaatcgaacccgcgacacaagcttgggaagcttggattttaccactaaactacgttcgcaattgcaaaattcattttagtccagtttggaaaaaatgtaaagtagaatttagttaatttacatggtaaaacgggttagcaaaaagtttgattatctcgctacttcaacgggtgcgaattgactagttttggtgccaatttattttttcgcggttataatagatttgaaaccatcgcattaacggaggaaaacaatgataaaacagacatttgaatttgatgatgagttacgggtaaatcgtttagggtacggaacgatgcaattgcctggacacggtgtctgggggcccagtgccgatgaagccaacgcggttgccgtagcgaagcgggtgttaaatagtgaagttaacttcattgacactgcggatgcgtacggaccgttttatgcaaatttatatctcaaagaagcgttaagggactatcaaggaccacataaaatgattgccagcaaagttgggttcacccgacaaggaccggacgtgtggacggtggttggcgaccctaattatttgcggcaacaggtagaattgaacttatggtctctaggactggactcgattgacttgatgcaattgcatcgggtggacccccgtttttcaattgaagaacaggtcggtgtcttagcagacatgcaaaaagaaggtaaaattaagcacattggtttgagccaagtttcggtggaagaaattaaacgtgcacaagcgatagccaagattgcttcagtacaaaactggtataacctgattgaccgccgtgacgaagcagttctcgattatgccgaatcccaacacatggcgtttattccgtggttcccgttggcaactggaaagttggcttcagaccaaaatagcattttgaaccaaattgcccagaatcatttggcaacgccgagtcaaattgcgttagcttggctattacaacgttcagaagtgattttaccaattcccgggacctcaaatattaaacactttgaaagtaacattcaagcggcgtacattacgttggcacctaatgaatttgaggcccttaatcaattagccggaaaagttaattagcaaatcaaaacatactctgttataatgattcagtaataagtagaatagtagtaatcttcagcgttatcctagcgagtctgagttgatgggagtcagatataaggcggagatgaaggcgtgattctacggatattaaattaaataaataagtggattattttaatcaagtagagtggtaccgcgggaaatctcgtctcttacatttaacgatgtaaggggcttttttttcgcagaaaggacggaaatatggattataagaatcaagttgttgcagcattaaaaccagttttaaacgaatacctatcggatagcgaaatctatgaaaagattgaagtgcctaaggaaagcaagctaggtgatttggctttcccaacctttacgctagctaaggttttgcgcaaagctcctcaaatgatcgcccaagatttagttgaaaaaattgaccaaagcgacttcgaaaaagttgaagttgcgggtccttacatcaacttcttcctagataagcaaacctttggtgaagaagttttaagaacggttcttgaccaaaagtcagcttatggtgataacgatgatggtcaaaatgggaacgtcccaattgatatgtcatcgcctaacattgctaagccaatttccatgggtcacttacgttcgaccgtaattggtaattctttagctctaattatggaaaaaaatggttatcacccaattaagattaaccatttaggtgactggggtacgcaatttggtaaattaattaccgcatataaactatggggtagtgaagaagatgtaaaagctgatccaatcaataaacttttggaatactacgttcgtttccataaggaagataaggaaaagcctgaactagacaacattgctcgggactggttcaagaagctggaagatggtgacgaagaagctactaacctatggaaatggttccgtgaagtttcgttacaatccttcaagcaaatttacgataagttagggattacgtttgattcttacaaaggggaagccttctataacgataagatggatgaaattgtccaaattttggaagacaaggacctcttaaaggaaagccggggagcgcaagttgtcgacttagaaaagtacaacttgaatccagccttaattaagaagactgacggagctaccctgtacattactcgggacttagcagcagccctttaccgttaccggacttacaattttgtccaatcgctatacgtggttggtgccgaacaaactaaccactttaagcaattaaaggctgtattaaaagaaatgggctatgactggtctgacgacatccaccatatccaatttggtttgattacgctgaacggaaagaaattgtctactcgttcaggtcgggttgttctcttggatgaagtcttgaatgacgcggtaaccttagcgaagaagcaaatcaacgaaaagaaccctgatttagctaatgctgacacggttgcaaaagaagtcggggttggcgcggtagtcttccacgatttgaagaacgaacggacaaactcctttgactttaaccttgaagacgttgtccgttttgaaggggaaactggcccatacgtacaatatagtcgggcacgggcagaaagcattcttcggaaggcagatacggaagttacaaccgatcaattgaagattacggatgccaatgcttgggataccttaaaagcattgcaagaatttccaagcgtagttcaacgagcagctgcccaatatgaaccatcagttattgcgaagtacgccttgagtttggcgaaatccttcaataagtactacgcaaattctcggatcttggcggacgatgctgaaaagccagcacgcttggcattggttaagagtgttagtttagtacttgaagaagcactacgcttacttggcgttaaggcaccggacgaaatgtaaaattaaccaactgaaattcaatataaaaaccaagcgcacaagtgcttggtttttttagtggaagaaaacgaagtaaaattgggcgggtgcttttaattaaaagcacatcaatctcaccaaaatttaatatagtggataaactacattttttttaacaaaaattgcggattttaatcctttactgtcaagttactggggtggtaattttttctaacatagtaggcgtcaaatcaattttaaaaaaggagtttttctatgatttcgccaaccatccaaacggaaatcaaaaaattttatatggctcaaccagattttggaaacttacccatgcaggaattagatcgactaagtgaagctacgcgttttaaacgggtgcactggggacaatggatttttgatcagggggatgagcttagtaacgtgtatttcttaaaggaaggtcacgtaaaagttacggcaatgaatgcggagggagacttaacatatttatcatttttaacgccacaggcaatttttccactgaggggcattcttaatggggaagaatactgttataattcaattgcgatcactgatttagaagtgtacatagttccggtaacggaaatccgacgggtgattattcataactacgcttgtctagtttcgtttatccagcggatggaaaggctagttgaacgtacaactagcttaattgaacagactacgagttcgaacgccacccaacgggtttgccaggtgttaagcggcttaaaggctgaatacggacaaaaaagagggacggtgcgtcaaattccgtttcaaattttgttaaaagacttagcggtgttgagtgggaccactacggaaacggtgacgacggttgtaaaacaacttcagcaacaaaataagataaggtataatcgaaaattgatttcgtttatttgatttaggacggggatgaattatgaaaaaagacgtacgacgcgagaaaattttagatttaattaacgaaaaaccgatttctacgcaattggaattattgcaggcactggcggatgcggggattaagacaacccaagcaaccctttcgcgagatattaaagaaatgcacttagttaagcaggccgatattacgggtgcactaacgtaccgggtgatggactccaaagagcaaattgagccggacaatagtcctattcgggaaatttttcaagaaagcgtgactaaaattacgcaagtccagttcatcaacattgttaaaactgagcctaaccacggaaatcgggtggcagcggtgattgacgatgccgatattgaagaaattcggggaacgcttgccggatttgatacgttggtaattttcagtgcggacgttgacgaagctaccgttttaaatcaaaaattaaacgaactaatgcaaactaactaaacaacgggaaaacctctaaaattcttgaaattagcaagctttaagagaatttactcttaagatgaagattcgggctaattaacgggatcaacgagaggctttctcgtttttacttattaagaccagtttaaaaaccttccgtaggtaaaggaaaccttatagaatatgataaaataccaacagtatcgtaatctgtaatgaggtaatattaaatggaaaatttttggaatgcgattaaagtatttctgcaaaaaattgggggcttttttagctggatttggcaaaagattcacccatttttacacaagtactggcatcgttatcaattaacccgctggattatcgtgattgttttagcggttatttttgtcaccagtgcagttttaacgtatcaagccaaaactgcaaacgttaaaaatttaaaagcggccttatcgcagccaacgttagtttacgacaaacataatgaaaaagcggggagcttatattcccaaaagggaacttgggtagatttagataaaatttcacccaacgtccaaaatgcggtaattgctaccgaagatcgcaatttttataaggaatacggtttttcggtgaaaggaattgcccgggccttcgtgatgtacggcatgaataaggtgttggggcgcaattacatttccggtggtgggagcacgttaacccagcagctggtaaagaacgcctttttgtcccaacagcagacctttacgcgaaaggctaaagagttatttttatcaattgaagtagaaaatgtttatactaaaaaagatattttggcaatgtacttgaataacgcctactttggtaatggagtttggggagtgcaggatgcatccgaacgttactttggggagagcgctgccgaattgacggttccgcaagccgccgtgttagcgggaatgctaactaatcctagtgcatacaacccggatgatcaccctaaaaacgcactttctcgacgaaacgtggtcttaaacttgatggcggagacgggaaaaatttcggattctcaagctaaaagctatgcgcagaccccgattgttacgtctaataactactccaatgaagacggttataagtatccctactactttgatgcggtgattgacgaagcaattaaccgttacggcctgactgaatcggacatcatgaaccgcggttacaagatttacacctacctggatcaaggtagccaagcgggaatgcaggatacgtttgataacgcgaataatttcccaagcaatgctaccgacggtactaaggttcaagcagcttcggtagcggttaatgctgatgatggcggagtggaagccattgttgggggacgtggcgagcacgtcttccggggttataaccgggcaacccaaattaaacggcaaccgggctcaacgttgaaaccaatcgcggtgtacgcgccggcgctcgctagtggttaccggtacagttcaattttggaagataaattgcaatcgtacgggactaatcactataaaccggaaaattacaacaaccagtattctggaaagattccgatgtatcaagcgcttgagcaaagtaaaaatgcgccggccgtttggctattgaataaaatcggggttgataagggatacgattacgttaagaaatttggccttaacccgagtgagggcgacaaaaaccttgccatggctcttggagggctgactaaaggggtatccccaattcaacttgcttcggcatacacagccttcgctaacgatggaaacatgtctaaaccacgttttatccgcaaaatcgtggatgcttctggaaagacaatcgttaataacacccctgaaaagaaacgggtaatttccaagaaggtcgctaatgagatgaccagcatgatgctgggggtttatggtgatagcgctggaactgggtacggcgcggaaccaagcggctatacaattgctggtaaaactggtagtaccgaagccgatacaagcgggaattcggaagccacccgggataaatggatggttggctacactaaggacgtagtggtcgctacttgggaaggatttgacgacaccaataaagaccaccatttggaaaatataactggtgtagggatgaacagcatgttcaaagccgaaatgagtgaaattctaccaaataccaagggcacgacgttccaagttaaatctgcgtcatcgttagcaaacaataatggcaacagtagtgcaggaaatctttgggataatattgaagatggaacttcttccattaaagacagtatttccaaaggtgctagcggtgttaaagaaaaggctggcgaactttttaaagacgcgaaaaagtttatcatggggcagtgattccagtattaaaaattagttctaaatgatataattgaactgttaaatcagaggaggcgcactatgactgtaaacatttatgataccgcaaataaaatggaacaagagctccgtctaaccaacgaataccaaaatttgaaacaatcttttgaaaaagttcaacaagacgagaacgcaagtgctttgtataagaagtttcaagatattcaaagttcgcttcaacaaaaacaaatgaacggcgaagagttaaccgaagacgaaattaaaaaggttcacgaagtcgctggtgaaatcgaaaaagtggacttgattaaagacttgatggacaaagagcggagtcttaatcagttgattaatgatgttaatcaaatcatcatgaagccgattcaagagttgtatcaaggataactctgggacggcaacgtgatgttgttcattcggtaaatggctgcgtaagtagtaggccgatttaaaattggtaatgataataaaacgaaaaagaggctggaaaagaaattccttgattaaggatgctttttccagccttatttttgataaaagtaatgctgataagggggacaaaaaatgaagtttatgcacgtagcggacgtacatttaggtagcccgtttcggggccttaaaaacataccggaacgcttacgtaaggtagtggttaattcgacaaaatcggcttttgcaaagttagtgcagacggccatcgaacaacgggttgattttgtttgcattgtgggcgatctatttgataatcctcgtcctgatattgacacgttgagttttgcggcggaccagttagacatactaaaccaagcccaaataccagtctttttgagttacggaaatcacgattaccttaacgctaaaattccaacaactatctttccagaaaacgtcacaatatttggtccagaagtggaaactaaaaaattaacgacgacggacggaacgatcgtggggttaactggttttagctacgccaaacgggcggaagtaacttcgcgaattgaagagtacccaactaatgacggacaatttgattttcaaattggtcttttacacgggagtatggatgggttacatgccagtgaagcaaggtacgcgccgtttacccttagccaattattagataagaattacgattactgggctttaggacacatccacaagcgccagattttgcacgaggatcccgtaatcgcttatgctggaaatacgcagggacgacacattaatgagactggggcgaaaggtgccagcctcgttactttggaacctaaccaaaaggctaaggtagaatttgtccgtagcgacgtggtggaatggcagagcttgacggtggctgttgaagagggggcggactttcagagcgtattgggcaacatcttacaaaaggccggcaccattacgtccccttcttttaaattaatgagtgttagtttagctggaagtaaccatttggcacccgaagttttggaagaattaagtaacggcctgggactatctcagctacaaaagcaattagactccgctgaagagtgggtataccgcattttactgaaggttgatgagcaaacgccagtattttccgaattggaccgtacttattggcaacaggccgctgaacaggtttttacgcctaaaacggttcaaaagcaactggggcggctaatggagttggattttatcgccgaagcttaccaagccgattttaatccagaagaactccgcgaacgagttgaaattatgctacaacaacgcaatgcgctgggggatgattaacgatgaaaattaagcgaattgaaatctatggatttggtaaatggcagaacgtgacgtttgatttacaaaacgatttacaagtgttttacgggcttaatgaagccggaaaatcaaccctgcgacagttcatttacagcgtcttctttggttttgcccaaggaaggggtagtaataaatatttgaaatacgtacctaaaaaaggacgtggttcggctggatatggcggggctgttgaaattgactaccaaaatcacccgtatcgaattgagcgcgtgaagggaaaaaatggcggtacggtaatcatcaaggatttacttgatcaaagtacggttactaacgattttttaagtgagatgttgggcccaattgaccaacatacatacgaacgtttactaggttttaaccaaagcgacttagatgattttaacgacttgggaaaccgggacgatttgcgtcgccatattttacgaatgggcgccgtgggtagtgaagaatggattcaatttgaaaaagatttaaaaaaagatgctgataaaatgcatacagctagttcacggacccgcgagctagataaaaaaattaagcattatgaaaaagctaaacagcatttacaagatgaccgtgatcaattaccggattaccaaagtgcaaaggctttagaagatcaaaaccgcgcagaattacaagaaatccggcagcaaattagtcaattatccaagcaaactagccaccagcaaaaattattagacgcgtggagtaactaccaaaaaatcactacgttacggcaaagagttcaaaaggcatctaaagctgatttgcaattggatttaggacaaattagtcgactagcggatcaaattcggaaagtagaggaaaattgccaacggactcagcaaaagctacaaaacttgccgcctttagcgcagaaagcggatgatttagatcagttaatggatctgcaagctaaactaccggtagctaaggttaatcgggatgaattagataaagcacagcagcaacaaaccgaattaaccaaccaacttgccgaattacaagagaataattcggtcgacttaggtagcgtggaaccaatggattctgccacccttaagcaagttaaacaacttttgcaagaacaagctcaagcggctgccaaggttaaccagttgagaagtgtgccgtcacggcaaactgcgtcaacaaacaagtcgactaacggtaacctgatttggggcgtgggagttgttttagcagcggttgacttcttcttaccggttaacgcaattattaaactgattttactagccgtaattattttgggagcatacggggtggttaagcaagttgatcagcctgctcaaccagcagacaatgcggcggacgatttgcaaaccgcggaagcaaatgggcggcaaattgatgaaaaacttcgccaaatcggtgtccaaactggttttgacgtggtgccagcgacggagtgggtatttttacaaaacgaagtggtgaactatcgccagctcgaacaacggttggctgaacttaaacaacggcaagcggttttacgggggaagcttgctgatttttggcaaacggcaaaaccaatcttacaaattgacgaagcccggccccaaccatcgctaaacgaacttaccaaatgggtgaccgagcgaattcagcaaattcaacaacagcaaagccaagtgcagactcagaaaattttgacgcaaaacttgaacgagcagcaggcggaattaaaacaactacgaactaagtttgcgcaatttgcaattccgccactggatgatcattttgacgaatggctggcgcaattaactgaaacacagaaacaagcggtccggttacgtgatttagaaaaaacggtggatcccgcaattcagacggaattacaaaagtatccggaacttaccgaactacaagcgcaacaaagcaaactaacggccgaattacagcaattaaaggcccaagaacaagcgctagtggatgaacgaacccagcgaatcggggaattaaccggtttaaagaatcaaattgatattttaaatgaacaacaagcccttgccgaagaagaaactgagctaaaagatttaattgatgagtggttaacgctacaattaggggcaaagtgggttgatgaaacccttggagtggctaccaaaggacggctgcctttaattattcaacaagccaacgagtactttgctaaaattacgaaccaacgttatcatcaaattgaatttgataatgacgatgctattcacgtggttgatcaaaatgggcaagcttatgaattaggggaactgtctaaaggaactttggaacaactatatatttccattcgttttgcgtttatgcaggcgtttgcggataccgtggatctgccaattattattgatgacgcttttgtagcctttgatgaccaacgtttagcggaaacatttggtttacttaagcaaattgctcaacaaacccagattatttacttctcggccaaaaaagaagtttatcaactggtagaccaacgtaacgtggttgatctaaacgaaaaataagggaggaacgcaggtttgactaaaaaattaattgattttcaaaatgacgaagaaatggaactttttgtcctgattaaaaacgccgaaaaacgggtgaccaagactggcaaagactttatctcgctcgttttccaagactgttctggtgaaattcgggggaattattgggatgcaaccgccactgattttgaacaatttcaatctgggcgggtggttcttctaaaggggaaacgtgaaacttataagggagctccccaggttaaaattatggcaatgcgtctggcaaccgaagaagaacctgccgacccctcggcgtatactgaaaaagctccggtttcggtgactgaattgcgggaagcctttgcgcaattagtatttgaaatcaataatccggattggaaccgggtggtccgttacttactaaagaagtatgatcagcaattctttgattttccggcggctaagtcaaatcaccacgcttttgaggggggattagctttccatactttatcaatcgttaaattggccaaggcggttgcacagcaatatgaaaatattgatcagtcgttattaattgccggcgcaattttgcatgatttaggtaaaaccatcgaactttctggaccggttgctactcaatatacggtggaagggaaccttctggggcatattgtaattattgacgaagaggtagtggaagctgcccaagcactgaaaattgatccaaatggagaatctttagtggtattacggcatctgttagtttcccaccatggattacgggaatacgggtcaccaatcgagccccacatgcttgaagcagtggtgcttcattcgctagatgacctagatgcccaaatccaaatggtctcgggagctttaaagaatacggatgagggtcattttagtgaacgaatttttggaatgaatggacggcggttctataagccacaaactaagtaattgggttatttgatagtaccgagcttattaattaagatcagtggatccaaaagtaaaaaacgcttctcaagaaatttaaaaattcttgaggagcgtttttagtttagcggattaagtttcagttcaggctctttaaccaaaaatcggcaactacgccagatttaggtatagtcgccgattcaagttagggttcccaaactaccaaaagtttgggacacgccttgtatataaactatttactgcttgtcgatgaagatgaagaactacctaagtaatcatctaagacgttcttaaggtctttatccttgatagtaacgttgcccttcttaagtaccttggtgattactttgcggagggtagcactatcgctcatgtcttcattccagattcgttcttttagttctttagtatggtcgtacatcttgcccttggcaggtttgtcgatcatcttaattacttggtaaccgtattgagtcttaacgggtttagtagtgtacttaccttcgtcaagcttaaatgcggcgttcttaaagtcagaatctaaagtagtgttagtgtcatcgaatggcgcaattttgccacccttattcttgcttgatgagtctgtagaatacttcttagctaatttagcaaaatccttaccgtcgttaagttgtttaataacgtcttcggcagttgatttcttagaaactaagatctgcgctacagtaacctttggttggtatgacttccattccttcttaaggtctgagctactaatcttgtcgttgtccttaacggcttccttcaataacaagttcgaacgaatttgtttgcgaagggaagcttcggtcatgccgtttgaagctaaaacatccttgaaggaagaaccgtattgatccttataagtattgtattgtttatcaacggctttcttagtaaccttatcaccatattgtttttcaagaactttattaacaatcatttcttgtaaaacttgcttaccgtttgaagtgtccttcaaactgctgtaatactcatcttgagtaattttaccacctgaagtagtggcaaccgtcttgctaccacacgcagctaaggtaaaagccatcgcaatgctagcgaatccaagtaaaacttttttcattaaatccacacatcctaacaatagtattagttaaactcagcacctatcataacataattaaggtttcgataaactttctcggataatcttaagaaaaaatttggctcattttctttttttagcaacaacttccttttgcgcctgattaagttcattactgagatgtttttgcagttcgttgatttttgccatccgaggttcgagtttgtattgaaaacggtcaaccgattgctgaatttcgttaaaggtcttttcactcttttttagttcaacctccatttgagccgtgtttaaacgtagactttggagagcgtctccaaaatcgctaatggcttgagcataattttttaccgaatgctttaaatcccttaagaagtgggggtgttggctaacgtatttaaccgtttgccaacctacccaagaacctacaattccttttagccaagggtgccgcttgttttttgccatgttattcacctaaattatctttaatttgattttgaattttggttaattgagcttcatcgtagtgactactgttgtctacaaaccgcatgccaaaatcatcatggtcggtataacgaggaacgaggtggaaatgggaatggaaaacactttggtaagcaattttgccattattgttaatgatgttcattcccttaatatctaggttactgtcgcgaacggctctagcaatcttgggtattctggagaatacgtcggctgcaagctgagggtcgtaactaaagatatccggcacgtgttttttggggattactaacgtgtgaccaggggttccttgcgaaatatctagaaaagcctttaccacgtcgtcttcgtagacggtgtaactaggaatgtcgccagtgatgattttacaaaatacgcaattttcgtccataaaattacctccaatacaaaacttgtcttatacaggctaattatacacgaaaattgcgtaattgtgcggattggcgaccgggttttcgagtgggatgtggtataatcgatgagagatttttaatacgattggggattataaattgacgctaaagattgagcatttgaccggtggatacacgcaaacgccggtcattaaagatataaatttagaagtgcacgaaggcgaattggtcggcttgattgggttgaacggcgccggaaagtcaaccaccattaatcacgtaattggtttgttgcaacccatgcaaggaaccatcagtttgaataatatccaactaagccagcaaccggcagcttacaaagcacagttggcgtacattcccgagatgccggtcttgtacgacgagttaacgctaaaagagcatctagaacttaccattaaagcttatgacctagatgaaaaggtcgcgtggaagaatgccatggaacttttagaaaaatttcgtttggcaaataaactcgaatggtttcctgcaaacttctcaaaagggatgcgccaaaaggtcatgattgtttgtgcgttcatgactgacgcccggctttttgtgattgacgaaccttttttagggttggatccgttagccattgatgacctactaggaattattaatgaaaagaaaaaacagggggcggcggtactaatgtctactcacgtgcttgatacggcagaaaaatactgtgaccggtttgctttgcttaacgaagggcagttaaaggcggttggcacactgggtgacttccaaacgcagtttaatgctcccacagctagtttgaacgatatttatttgtcgattgcaaagggtgagcgtcatgagtgaattgtggcaacagcgagctaaaacttaccaatctgaaattctcaaatatttaaaatacgtattaaatgatcatttagttttagccctgttatttttcgggggcggcttagggttagcgtacgctaattggctgaaaactttacagcctctgccaaattatggcctgattttagtggcgacagttagttttttgctaactttgcctgggcagccagtgctcttgcttaaaaatgctgatccggtatttttaatgagccaggaaaaaaatatttctgcctatttaaggaaatctttacgtcggacgttaatttcagttttaattccggttggcatcggtagcctgttgctttttccactgttagctttggcttaccaccaattattcttggtggtgggggtcatcctaacagttatattaggcagttttaccaacgtattaattcggtatcaaggttattactttgcaggttcgcggtgggactggaaaatcacgttgctcattgacgcgattattgttagcttaatcataagattccctttaatagccgcggtgcttatgttgggatggttagtattagaatggcagcgcctaaaccgcctcatggaaaagggcagttttaattggcaggcggcggtcgatgcggaacaaaagcgaatgggacggttataccgcttcttcagcttatttaccaccgtgaaaaatttgcccgttaaggctaaacgacgtcgctatgccgatggtttagtaaaatttttggcaggaaaatcatcaatgttttcttacctatactcaattatgattgtccggagcggtgacctaggaagcttgatgatccggctcttaattgtgggcatgctaattgtggcgtacagtgatcaggaatggttaaaactgatggtgggcgcgttaaccacgtatttaatcgtgattcaattagtagacgtttaccggcccgttcaggcaaattcaatggtgcaagtgtaccccgttgatgcagaaatggcacaaaagggcttgttatccgtcttaaaaagaatcatactattaaacgcgattttattaacgctggccggctgcgtgactaattggtcgctctcgtttttaggatgggcaatcgtggtccaagcgattacggcctggttgctaactcagtggttagtaccatgttatattaaaaaaataaacagataaaagaggtaattatgcgagtaagaaataaaccgtgggctcccaagttgattgcggagcaccctgaaatggttgttgaaaatggacaggcttataaaggaaagtggcatgaacgttttgctaagcaacaaccactctggatcgaagtggggactggtaaagggcagtttatcatcaacatggctaaaaaatatccccaatacaattttattgggattgaaattcaaaagacagtggtggcgatggcgctaaaaaatgctttagcagaagaactccctaatttacaatttttacatgcggatggcgcagaattaactgattattttgcagatggtgaagtagaccagctctttttgaacttttcagatccatggcccaaaacccggcacgaaaaacggcggttaacttataaaagctttttgaaagtttacgaacaaattttagtcgaacacggtaaattagagtttaaaacggacaaccagggactttttgagtattcattgactagtctcaataattacgggatgatttttgaaggagtctggttagacttacacaatagccccgaaaacgaagacaacgttgaaacggaatacgagcataagtttagtgaaaagggccaaccaatttacaagttagttgctcatttttagattaggcaactaaaccggcagagacacaaaaatagccgagaaaatttttctcggcttgctttggttatgattaagaaattaacgacggtaaatgtcgataattgtgccagtgtaggcgtcggcaatgaactcgtattgaattagttcgttattttcgtatttggtgatgccgccgtaatatacggaggcctttagaccatgccggttaaggggagatggcttggactcgatccaagcgccttcaacgggcccctcttcttcaaaagaacgtcggacacgcgcaagggcggcttggggacgaactttacgatgtcccttaatctgagttgccaccaacgtgcctacggcgaacgaagctaaagcggtgatggttagtgcagttaacgcagatgttttagatgacatgaaaacacttccttttccattaattctaacattaatgggaatggtttgagaattaaaaagtaatatttaaggagaattgagatgttagtagctagttataatccaaaaacaatgggagatattttaattaccatggttaaccctgatgcggaaaagcaggcggtggagcaaaaggataacgtagtgcggatttttgacgccgatagtaacgttaccaccggatataatttcttagaagttagcaacgtgttacccgagttagatggccacggaccggttactttaactgccgcgcaagttacaaagttaaatgaacagttgcggcaggcaggttttgcagatgaattggttgctgacgaaagtcctaagttcgtggttggatacgttaaaacggttaagccgcacccagattctgatcaccttcaaattaccgaaaccgaagttgacaatggcgaaacacttcaaattgttagcggctcgccgaacatgaaggctgatattaaagtcgtggtggctaaggtaggcgccatgatgccagatggaatgattatatggcctggtgaactgcgcggtgtttctagtgacgggatgattgcttccggacgagaactgcacttaaaaaatgcacctcagaaaaagggtgccttaattttaccagatgattttgaagtaggaacggcttttgatttcgcaaagggaaatcatatttttgactaataagggaaggatttaaatggttaaatacgatggaccggctttttttcgcaaaaaaggcctcaaaatggacgaccattcggttagaaaaccaacggattcagcgaagaggttgaagtcggatcatccatttacgcccgcaattcagcaaaaattggcgcaaacgcaagcccctgacaccgaagcgagtgatctcaaaagtacagttaggtcttcagcacgtttggaatccgattcgactaattcggttgatagtcgacctgtacgtcgattccggttgccaattagtaattacgaattaactcggcgacctttacccagattgaatcaagctaagcgccaactaactagtcgccaagagttaaacgatccggtacttgatgaatcggcggccagcgattctgacactacgacttcgcgcgaggagcaaagtcattcattagcaagcgctgctccgggagtaccggaaactaagccggttacccaatcgaccgctccgtctgcagcaattccgccagcttcggcgcaacaattagacgaacgggcaaaaacggctagtgtaacgtcgaagagttttactcagccggtggaagtacctaaaaaagttactaacccaaggcaaacggcatgggaacccgctcgttcggttaaagaaccacaaattccagtagcgcaagaaaccactaaacaaatgctcgggtaccattttccgagtttagacctactaccggatcctgtcgttcaaaacggagatgaagaccaatgggttgccgaccaagcgcagcggttggatgatgcgttaaacgcctttgaagttaccgctaaagtagtcaactggacggtggggccaaccgtcactcagtttgaaattgaacttggacgcggagttaaagttaacaaaatcactaatttaacggatgatttaaagctgcaattagcggcgcgggatattcgaatcgaggccccaattcctgggaaaaataccgttggaattgagattcctaatccgcatccgcggccagttccgcttagtgaaattattaaatcgcctgtatttcaagaaagtaaatcgccgcttacgattgctctaggggtcgatttatttggtaaaccgcaagtctatgatttacggaaaatgccgcacggattgattgctggtgccactggttctggtaaaagtgtgtttatcaacagtgtattggtttccttactatataaagcaactccgcaaatgctgaagttgttgttgattgatccgaaggccgttgaaatggcaccgtataaccggctgccgcatttactagcaccggtcatttcagatcctcaagcggcagctgccgcattgaagtgggtcaccaacgaaatggatcaacgttacgaacgcttggcagctgctggagcccgtaacttagaacaatttaatgaaaaggcccgtcgcgcaggagacgatgctaaccaaatgccatacattgtggtgattattgatgaattagctgatttaatgatggtttcggcagctgaagtgcaagattacatcgtgcgaatcacccagaaagcgcgggcagcgggaattcatttgctgattgctacccagcgacctagcgtggacgtggtcacggggttaattaaaaacaacattccaacccgagtggcgttcatggtttctagtcaagtagattcacgaaccatcttggatcaaagtggagcggaacggttacttggacgaggagacatgctgttccttggtaacggaaagagcaatccggtgcgtttacaaggagcatttattagtgacgcaattgatgatattgctgattttgttcgtgaacaggcggcgccgcattatgcattcaacccaaccgaactgaaggaaaagagtgcggaactaaatagcacggacgagttgatggatgacgtccttgaatacattgctcaagaagacactatttcaacttcaaaattacaacgggttttctcaattggatataaccgggcggcaacgattattgaccagttagaggaatcaggatatatttcggcatcacggggttctaagcctcgcgaagttttttatcacccagaagaaaatgatgattaatattgtggtaaactgaaaacaatttattatgggagtggtaaaggtggataaagatacaatttattattttattgggattaaagggtccggaatgagctctttagcattaattttacatgacgaaggttatcaagttgagggctctgacgtagacggctacgtttttacccaagacggtcttgctgcggcaggcattaaggtattgcctttcaacccggataacttacgtgacggtttgacggtgattgcgggaaacgcctttactgatgaccatcctgaaataaaacgcgctcgcgaaatgggcttaaaggtcgttcgttatcatgaatttttaggacaattattagccgcatacaccagtattggagtggcggggactcatggaaaaaccagcaccactggtttattggctcacgtgcttggcggagtagacaagactagttacttaattggcgatggtactggtaaaggggttcccgatgcccggtttttcgtgtttgaagctgacgaatatcgtcgccacttcatcgcataccatccggactatatgatcatgactaacgttgattttgaccaccccgactactataaagatttggccgacgttgaaagtgccttccaacaagcagctagtcaagttaaaaagggactttttgcttggggtgaagatgcaagcttacggaaattgcatgctgatgttccggtttattactatggaactgcagacaatgatgattttcaggcgaaaaacatcgtccggaccacgaccggatcagaattcgacgtggaacaccgcggtgaaccaattggacattttaaaatcaacctttttggcgagcacaacgttctcaatacgttagccgtaattgcagtagcttactttgaaaagattgatttggcactagtccaaaaggaattactatcgtaccaaggagttaaacgccgtttttcgaaatctacggtaggtgataacatcttgattgatgattatgctcaccacccatcagaaattaaagcgaccctagatgcggcacggcaagaattcccagataagaaaattgttgcagtatttcagccacatacttatacccggacagccgcgctgctagacggctttgctaagagcttgagccttgccgatcaagttgttttgaccgagatttttggttcagttcgtgaagcaaacgggaaagtttcgtcacaagatttggctaatttaattggtcatgacacaaagattatcgatgaagacgacctatctgcgttagcaaaccaacacaatgcggtgctagttttcatgggagctggcgacattttaaaatacgaagatgcttataaagccttggttaaggaaaagtaaaaatttgacctttcttgactttgattgatagccttttagttgctttcctgttacaatatgggaaagatttaaatggggggatcaatttggatcaacaaccaagagtaataaataatacaatcggcttaaaccgatttttaactaaaatgtacggttggatggcggccgcggttgctttttctggaatcattgcttatttaggcgctacagtatggcgcccagcggtgatgacctttctaagccaagggcggatgggtatctggctgattttcattgcgctatttcttttcatgatttttgggcagaagacggcgctacaaaatccaacggttagtttcttaatgttgtttgcgttctcgggattctttggaatcacgctttccagcgtgtttatgctcttcagcattggaacgattgcgggagcgttcttctcggcagctgccgtgttcgtcgtgatgagcgtgatcggattaaccactaaacgcgatttgtcgcggttggggacgcatttactggctgctttaatcgcaatggtggtcgtttcggtgattaacctattcttcttgcacagcagcgcagtaacgttcttcttttccttgattggaattgtaatttttgctggtttgtcaatgtttgatacggcatcgatgaagaagctttacttgagctatggcgaccgggtttccgaaacgggacttgccattcaaggggcatttagtttataccttgatttcattaacctgttccagtacttcttaaccatttttggttggagtcgagattaatcaaaaatttaattttcatttagaaccgaaggtcaatcttattcacgttggccttcggtttttggtatgattaagggagatagaaaacggaggaagctatggcaaaagataagttattgttaattgatgggaacagtattgcatttcgttcttttttcgcgttgcataattcgctagaaaagttcaagaatccggatggactgcacactaacgcaatttttgggttcaataaaatgttggacagcattttaaaacaataccagcccacggcggcattggttgcttttgatgctggaaaaacgactttccggacggaaatgtacgatgattataagggaggtcgctcaaaaactccgccagagttatcagaacagatgccttatatcaaacagttgctgaccggatacggtatcaaaacttatgaattacctaattatgaagctgacgacattattggtaccctatcgttagcagcggaacgtgacgattacgaagtggtggtggttaccggagaccgagatttaacgcaattaagtagtgcagaaactaccgttgcggtaactaaaaaaggggttagcgaggtcgaagagtatacaccgcgccacgtcaaagaaaagctgggaatcactcctgagcaaattattgacttaaaaggcctagcaggtgacacttccgataattatcccggggtaactaaggtcggtgaaaagaccgccctcaagttgttgaagcaatttgggacaattgagaatctttacgacaatttggatgatttgaaaccaagcaaaatgaaggaacacttgattgaggatcgggatgcagcctttacttcgaagacgttggcaaccattaagcgggacgctcccgtagaaatcggattggcagatttaaagtatgacggaaaaaacatcacctttttacaagaattctaccaaaagatgaagttccggactttcttagcggcgttacagcaaaataaaccaacggaagaaagggtaagtgaaaaattagcgtatcacgtattaacgaaggatacgttaccggactttaccaaatgggggaaagaaattaacttctatttggaaatgccagagaaaaattatcacctatctgaattttgcggattcgcaattggaactgataaagagctttgggtaagcgacgacgttgaattattacgagaacccgcgttatctgaaatattagcgaaccaaaaggtggtcgtaaacgtctttgatgggaagcgtacttacgtaggattacatcgactaggcgtgaccttaaataacattaactacgatattttattacagtcctacctgttagataccaacgataattctaatgatttggggcaacttgctcacgaacatgacattgaagacattaaaaccgatgcagaagtttacggtaccggagctaaacgggcggtgcccgcaaaagacgttttactagagcacctcgcccacaaaattgacgtaattggtgaactagggcggcgcttgcaagaagagttgattaacaaccaacaggccgatttatattggaaaattgaactaccattatcgattgtgctggcaaagatggaaattagcggaattaaggttgaccgcgagcgtttaggggctatgcaaagcgaattgaccgaacggcttagtgagttggaaagccagattcatcaagaggctggggaagagtttaacattaactcgcctaaacaattgggacacattttatttgaaaaactagaatttccagtaattaaaaagaccaagaccggatattcgacagcggtcaacgtcttagagaaactgcgcggctactcgccaattattgatcacattttagattaccgaacgatcgctaaaattaaatcgacgtacgtggacggtttgttgaaggtgattcattctacggatcaaaaggtgcacactacctaccaacaaaccttgacacaaactgggcggttgtcatcaacagacccgaatttacaaaatattccaattcggattgaagaaggcaagaagattcgacaagcctttgttccgtcacacgaaggttggcatattttatcttctgattattcgcaaattgaattgcgcgtgttagcacacattacgggcgatcatcatttacaagaagcgtttaagaaggacgaagatattcactccagtaccgcggtgcggatttttggtttgaaggatgctagtgaagtaactcctaacattcggcgccaagcaaaggcggttaacttcgggattgtctatggaattagtgattacgggctttcccaaaatattggaatttctcgtaaggatgccaaacggttcatcgacacttactttaaagaatatccgggagtaaaaaaatatgtagatggttcggtagaaactgcgcgcgagaagggctatgtagaaacgattgcccaccggcgccggtacttacctgacatccacgcttcgaactttagcgttcggtcatttgcagaacgaactgcgatgaacacccctattcaaggtagtgcggccgacattattaaaattgcaatgattaacatgcaaaacgagttagaaaaacggcagttgaaaaccagaatgttgttacaggtgcacgatgaattgatttttgaagtgcctgatgaggaaatgagcgttattaaagaattagttcctaaagtgatggattccgcaattaaattggatgttccgttaaaagtagaaacttcatggggaaataattggtacgacgctaaataacggaggaatgaataaatgcctgagttacctgaagtagaaacggtacgacgcggattggtcggtctggtagagggccgtacaattcaacgggtggtggtgcgatatcctaaaatggtcacccctgaagcggaccagttcgcggcagaattaaaaaataaaacaattgaaacaattcgccggcgaggaaagtacttgatttttgatttcagtaatcagctttcaatggtttcccacctccggatggaaggaaagtacgcggtggtagaccgcgaccaaccttacaacaaacacgaccacgttatttttgaattagatgatggacaggatttacgctataacgatacccgaaaatttggtcgaatggttttaacccccacggggcaagaaatgcaagtcgggggattgaagacgatcggacccgaaccaacgccagaaacgctgacgttagactaccttacgaaggctcttcgaagtcgtaaacgggtgatgaaaagctttcttctagaccagtcgttaattgcgggattgggcaatatttacgcagatgaagttttatggctaagtaaaattcatccgcagcgccggtctaattcacttaccgatgccgaaattaaattattacgggaaagtatttttgccgaattaaacgaagccattgcggcaaagggaaccaccgtgttttcttatttggatgctactgggcatgccggcagtttccaaaatcagctgcacgtttaccatcgccaaggattaccgtgtccacgctgccaaactcccatcgaacaaattaaggtagctcagcgcagtactcatttttgcccgcattgccaagttttaacgccagaaaatgactaagatccttggactgacaggtggaattgcgatgggaaagtccaccattagtaattttttgagagataaaggaattccaattgtggacgctgatgaaattgcccacgcagttttggaatttaaagcggttaaggtacaattagttaaggcatttgggaccccaattttaaatgaacaaaaacaagttgaccgtaagcaattaggtaaaatagtttttggggagtcaaaaaaactaggggagttaaatcaaattgtccaacccgtaattcgccaagagatcatccgccagttaaaaagttttacgacggagtccgtggtcgttttagatgcaccagttttgttcgaacaaggatacgagactttagtcgattgcattatggtggtttcaacaactccagcagaacagctccgacgactgatggaacgggatcatttgactcgtgaggatgctcaaaaacgaattgacgctcagatgccgattgaaattaaacaaaaaaaatcggatgtaaccatcgatagtagtggtagtattgaagccacccaaaaacaagtgatagaatggcttgttaaacaaaatttactccagacatccggaaagaccggcgaggtgaaataatatgaaatgcccacattgtggtaataatggctcgagagtagtagatagtcgaccaactgatgaaggccgcgtaattcgtcgtcggcgtgaatgtgaagactgtggttttcgttttacaacttttgaacgggtggaagccaccccgttattagtgattaagaaaaatggttcgcgggaagaatttgatcgcgataagattcttaaagggattgtccgggcagcagaaaagcgaccggtaaaaatggaacaaatgactgatattgtggacaaggttgaaaataaaattcgttcattgggagaaagcgaagtttctagtcaagtgattggagaatacgtaatgaatattctcgttgatttagatgagatcgcttatattcggtttgccagcgtataccggcaatttaaggacatgaacgttttcttgaatgaactccaggatatggtcaaaaaagatgaagaagaaaaggatcataagtaatgacggaaccaatgggtaacttagcaccaaacgactcgtttattgtgaatactgatcgacaaatgaccgactacgaaagtcgggcattaacggcgctgtatcgtccgttattatcttcggatgcgtacagtttagcaatgacgctttgggaactaaatgaagaagcgacggttttaaatgaacagtttacccatacaatattactgaattggctgggaattgatttaccagctattatggaagcgcgaggccggttagaagccttgggtttgctaaaaacttttcgtaaacaagttgataatcgggcgttatttttgtacgttttgcaagcgccagctgacccgattacctttttcaaagacgacacgctaagcgcattgttgcttggtgcggttggtgaaaatgaatttgaacggttaagtcggcggttaattaaacgccaggttgagcacgccgatttttatgatgtctctaaaaatttaggcgactatttccaaattggcagcagcgtggtcgacaaaccaaggccaatctctgccgtgcaaaagcaaattcagccggacgagccacaaacggattcagaaacgctcaataataattttgactttaacttacttactcaaatgcttagcactagctttgtagatcgtcaaagcctagaagaaaatcgccacctcattatggtggaacaaactatttacggaattacggaaagtgaaatggcagaactgattaagtcggccactaattttcaagataatcggattgatagccgaactttgaagactcggatcgctcaaaaatacgccaatgctaatcagcaaggtgcgaagaaaacggctagttcagcggctatgccaacttcgcctacaaagctcaatttagaagggctcacggccgaggagcaaacggtgattaagtcaacgtatgcattggctccggtagactttattgatcagattaagcaagaaaccgggggctttaccaccacggcggaaaaacgggtaattaccggcatagtggaaacgggtcaactgccggttagcgtcgttaattttttgattttctatgtcttggttgatcagggccgggcgacgctgaataaaaatttagttgaggcaatcgccaacgagtggattaaaaatggcgtaaaaactccgcaaaaggcgttagaatttgtgcgtgaacgccaggctaaaaagcaaaaacaagctaccaagtcgtatggaagacgtaagccggtcgttcagcgcgaaaccctaccagattgggccaaaaaagatactacaactgcaactaacaatgctaatgattctcaagcggtgccgactactgcagaaattaatgcaaaactgaaaaaattacgtgaacggcgaaaggaggagtaacaaatggaaaatattcgcgaagcaattgagggattgatgaataaacggaaactcgaccaacgtttccagtcggtgatgaaaactgtttatcaggatcccgaagttgtggccttttgccaaacacaccaagcggagttaactacggaagctttggagcggggagcggccaaactatacgaatttgttaacgaacgcaggaagattgcgcggcacgagccctcctttttgccgggttacgagccccagttagtactcagtaatcacctaattgatattgagtacgtacctactaaagaaatgacaatgagacgccaggcggcccagcggcaagcgctggtgaagtcaattagtatgccaaagatgattcggcgggctgattttagtgattactaccaagagcctgaccggaatattgctttaagtaagacgatggattttgtggccgcttatgatcaggcaccggaccaatttcaccgaggcttgtacttaaccggtagctttggggtaggaaaaacttacttgatgggtgcaatggctaatgaattagccaaacataattactcgacaaccatcgttcattttcctagtttagcggtggaattaaaaaacacgattggggattctaaagaaattcaaagcaagcttgacgcggtcaagcaggcgccaattttagtgattgacgacattggtgcagatagtatttctgcatgggtacgggatgatattttaggcgtaatcttagaatatcgcatgcaagaagagttaccaacgttcttcacctctaacttttcaatggagcaactagaaaaggaacacttaacggtcaaccaacgcggggaggccgaacctttaaaggccaaacggttaatggaacggatcaaatttttaagtgaagaggttactttaatcggaaaaaatcatcgacagggttgacaagcaattttgaatggatataatgaagttgtaaatcagagtcaaacatgtagtttttaacctcagggagccgcgccatggactgtaagcaaagcaactaaaaacttcccacttgactagagactgatcgaaatatcagttcgggttgccaccgttatcggtttaattaagtggtggattacgttctagtagtctgcaacgagggtggaaccgcgtgaaataacgtctaacacgtccctggtatgaaaataccagggatttttttatactattttttgtaaagggagcgtgtaattatggcagagattaagattgaatttccagatggcagtgtaaaaccttttggtgctggtgtcaccgtacttgaaattgcgaagtcaattggtacaagtttggcaaaaaacgccgttgctggaaaagttaatgatgaattggttaatttggaccaaccacttgaccaagatggaaaggttgagatcattaccaaggattccgaagatggacaattggtaaattggaattcagcagctttagtattgacaagcgcaatcaagagcatttatccggaaatccggattggggaaattggtaacatcgaacatggtttttatgctgacaccgataaggaaggtcaacaaatttcggtcgacgaactccccgctattgaagataaaatgaaagatatgattcaagcaaaggttgctttgagtcatgagatgttaagcgttgaagatgctttagctaaggttgatagcgacccttaccaagctaagctagttaagaaaaacgctaaagacggcaaggttaacgtatacgacgttgatggcagcttaatcgtcagtgactgtgttgcattaccagatgcttcgggattaaaagccatcaaattgctatccgttgcgggtgcttattgggaaggtaagtcaagtaatccaatgttacagcggatttacggtacttcgttcttcaaccaaaaagacttggatgctgaattagcacgccaaaaggaagctcgtgaacgtgaccaccgggtaattggtaacgacctcgacctcttctttgttgatccagaagtgggcgctggattaccatactggatgccaaacggggcaaccatccgtcggacaatcgaacgttacatcatcgacaaggaagtccaacatggttaccaacacgtatacacaccagtattaatgaaccttgatgcgtacaagacttctggtcactggcaacactatcgggaagatatgttcccaccaatggacatgggtgacggcgaaatgcttgaattgcggccaatgaactgcccatcccatattcaagtttataagcaccacatccgttcgtatcgtgaattaccattacggattgctgaacttggaatgatgcaccgttacgaaaaatctggtgccctttctggtttgcaacgggtacgtgaaatgacgttgaacgatggtcacactttcgttgcgcctgatcaaattcaagaagaattcaagaaagttctacaattgatggttgaagtttatcgcgactttgacattacggattacacattccggcttagttaccgtgatcctgaaaatactgaaaagtactttgacgatgacgagatgtggaaccactcacaatcaatgcttaaagctgcgatggacgatcttggtttagattacgttgaagcagaaggcgaagctgctttctacggtccaaagcttgacgtacaaacaaagacggcacttggtaacgaagaaactctatcaacaatccaattagacttcatgttgccaaaacaattcgacttacattacgtcggagcagatggtgaagaacaccgcccagttatgattcaccgtgggttagtttcaactatggaacgcttcacggcctacctaattgaaatgtacaagggtgccttcccaacttggttagcaccaaaacaagtaacgattatcccagttaaggatgacttgcatggtgaatacgcagataagttgcgtgaacaaatggctgaccaagacatccgggttgaagttgaccaccgcaacgaaaagatgggttacaagatccgtgaagcacaaactcaaaagattccatacatcttagtagttggggacaacgaaatggattctaacgcggttagtgttcgccgctatggtgaagataactcacaaactgtttcagtagatcaatttatgcaagatattaaagctgacattgatagctacagtcgcaaaaattaaaaacttttagctttcgggagctatgtaaatccaggtgggtttacatagctctttttagttgtccaaatggctttaaaagatcgatctacggctaagcaaggaaaggcgtttcatgtataattgaaggaaaggaacttcttaagcacgaaagaaggattcagatgctaaatttaaccttactaatgattgaacgggtgggcctgattattattttggccttttttctcgttaattttccgccgtttcgaaaattactctttcgtcaggacggcgccgctaaatttaagttgataatcatctttgctttctttacgattacggctaatttgattgggattgagctttcgcctgataattcgatccactttaatccgttattattacgaattccagcaggctattcggtggctaacatccgtattttaacggttaccgtttctggaatcattggcggaccaatggttggtgggattgtcggcgcagttgctggagttcatcgtgttttacaagaatccttaactaacgacgcacttttttatattccaagttcaattttgattggaattttatcgggatggttttctaatcaaaagcagcatcggtttgcgactatgaagccgtggcacggttttttaattggattattgatggaaaccatccagatgacttttatcctaatttttagtcccacgggttggcgattggtaaggtatatcgcgattcccatgattacggtcagcgcactagggacttcggtgtttttatcaatcgttgcattatattttcgacaagaagtggatgtacaagcaacccaaactcgttcagtgctccagttagcattaaaaacgttaccggcatttcgccagggacttaattacaaatcggcccaagaagttgccaatttaatgcttaagtacactaattttgatgcaatcggaattacggataagcaaaaaatcctcgccttcgtcggggcggggagcgaccatcacattgccgggcaaccgattcgaaccgatctgtctttgaaggcgattcaatccggagaggtacaaattgccaataattttcacgaaattaattgttcagagcccaaatgcccgctccattcggcaattgtggtcccgttgtttattaaagaacagattattggcagtttaaaagtttactataaagaacagtggcgattaagcccggtagaaattcaattagggatggggctcggagaaatcttggccatgcagattatgctgggtgatatggaaaggcagactgagctggttaaggatgcagaaattaaatcgttacatgcccaagtgaacccgcactttttctttaacgcaatcaatacaattgtcgcggtgatgcgccaagacagtgaaaaggcacgggagttgttgattcaattaagtacctatttccgggctaacttgatggggagccgggaggtggtaattccattatcacaagaatttaaacacgtaagagcatatttatctttggaacaggctcgttttccaggaaggtaccgggtgctgtttagcaacgcggtgtccgaaaatgccctcgtcccaccgtttacaatccaaattttagtggaaaatgcggttcgccacgcctttaatcccaaaatgaaggatcaacagattaaggtgggggttagtcaagttgccaacgcgttaaaaatcgtggttgcagataacgggcacggaattgaccctcatatcttaaaacagttaggacaccaggtggttgattctcaaagtggtagtggaacggctttacaaaatttaaccgcccggtttgcgggactttacggtgaggcagcaaatttagatattcaatcaagctctgaaggaacgacaatcaccgtgaaaataccatttcaagaagggaagcaaacgtgatgaaagtattgattgttgacgatgagccattagctcgccaagaattaaattacttattggaggaaaaccccatcgttgaccaggttgcggaagctgatggagtggtggaggccgaccagtatgtagcaaatgaacatcccgatttggtatttttggatattaagcttgaagatggtaatggaatggctttggcgaaaaaatggaagaaaatgccggtttcaccatacgtgatctttgccactgcttacgaccaatatgctttagatgcgtttagtgctgaggcagtggactacgtactcaaaccatttgagcaaagtcgcattaatgaagcgcttgaccggatcaaaaaattattggatcggcagcaacgcgattccgccaattaccagcaaaaatatcttaatccgcgactgtcaattactaatgaagaacgaacgatcgtgattaagaaaaataacattatttatttagaagcgcaggggggcacggtaattattcacgtggccaatttaccattagttaccagcaagcagcccctccgaaaactattggcagaattggatccgcaaaagtttttgcaagtacatcgtagttacgtggttaaccttgattcagtttttgaattacaaccaagtttcaaccatacctaccaattgacgttatcgaatggaattaagattccggtgagccgttcgtacgttaacgaaaccaaacgccacttagggatgaagtgagtaataattcgggtgacttagttgatggaaattaaagttattccataaagttttagttattttaatttttaaaaagtgatcacaactctaggttaaattgcttagagaagtggtcactttttatgttgaaattattaagggcatttcatctcgggtagttggtattctatccagaattagggtcaattgattgtgaaaacggttacaaattgatcgaaatcacttagaattaatggtgagcaagggaagaaaagcccttgaatcaagtgttttaaggaggaattctgatgaaaaaagatcaagagaaaaagaagacgccgatccttgttcaaatggcgatttttgcggcgattttattcgtttcgcaaatcatttctcagctatttcccgcaaacattgtggttcccactccgttaattggtatgattattttatatattttattggcgacccacattgttaaactcgaacaagtttaaaaatttggtgactttatgattggcttaattgctttcttattcgttccatcgggaattcaattagccggtagtttggatttaatgaaaggggaagggctccaggatattatcgtggtggtcatttcgacaattattctcctggtcgtaattgcatacgtaggagcatttttcattcgaattcaccaaaaaattacgggtaaaaagggggacgatgaataatggatgcagctttagcaacaccgtttaccggaatttttatttctttagtagtttatctaattggaatgtggctttttaaagttagcaaaggcttcttcctatttaccccgttattagttggaatggttttaggaattgtaatcttagttctttggggaaagggaattggttccacaactgtcgcagtttataaaaagtactatttaccaggcggcaacatgattttttggtttttaaacccggctaccgtggcgtttgcgattccgctatatcggcggaacgatatttttaagaagtactgggtagatgtattcctaaccttgttcgtcggtggttttatttccctatttggtattcacatggtctccaagctaatgggactatcccgagtttcgattgcggcaatgctgcctcaatcagcaactaccgcaattgccatgccgattgcaaaggggatcggaggggatccggcaattacggcgatggtctgcattatcaacgccgtaattatctacgcgttggccgaattcttaattaaaatctttaagctcaaaaatatctctaaactgggaactggattaggactgggagtttccggacacaccgttggttcagccaaagcggttcaattaggttcaattgaaggtgcaatggcatccgtagcggttgtaatcgtttcactagcgatggacattctagttccaatctacgtaaacctctttatgtaaaaataattttttagtttagttgacagagactgattattttggtatcttagtaaacgttgagaaaaagcagaggccaccgcttctcgccttgtaacttagaagttgctgggctaaagaacgttgaatggatgttgaagatccaaaaaagcgggtggcgtgtgccatccgcttttctgcattctcgataattttcctggaggtgaagaaccatagcaaaagatacaatggtaaatgaaaccattcgggctcgtgaagtccgcttgattggtgttaatggtgatcaattaggggttaagtcaaaggcagaagcaatccaaattgctgaagaagccaatcttgacgttgtcgtagtttccccaaaggcaaaaccaccagtagccaagattatggattatgggaaatatcgtttcgagcaacaaaagaaaaaacgtgaagctcgtaaaaagcaaaagactgtcagcattaaagaaatccgtttgagtccgacaattgatacaaacgactttaacactaaacttaagaacgctaagaagttcttaggcaaaggagataaagttcgggtatcaattcgttttaagggtcgggcaattacccataaagacattggtcgtaaagtgcttgaacggatggctgaggagacttctgacatcgctcggatcgaagctcgcccaaagatggacggtcggagcatgttcttggtattggctcctaatgctgataaataatttaaatttctggaggaacagattatgcctaaaatgaagacaaaccgcgctgctgcaaagcgttttaagaaaactgctaatggcggtctaaagagtgcaaatgcttttacaagtcaccgtttccatggaaagactaagaagcaacgtcgtcaattacgtggtacagacatgatggacagtactaacgtaaagcgttataagaagttactttcaaacatcaagtaattaaattaaacagaaaagtaaatgacctgcgggtgatttaaggaggaattattatgccacgagtaaagggtggaacagtaacacgtcgccgtcgtaagcgcgtattaaaacttgctaaaggatatcgcggagcaaaacatattcaatttaaggttgctaaagaccaagtaatgaagtctggtttgtacgcattccgtgaccgtcgtaatcgtaagggcgaattccgtcgtctttggattgcacggatcaacgctgctgcaagaatgaacggtttgagctacagcaagttaatgcacggtcttaaggaagctggtatcgacatgaaccgtaagatgcttgctgaccttgccgtaaacgatgctgacgcatttaaggctttggctgaagaagctaaaaaagctctttaattagatacttaattaagtgactactaaaaaggatcgtccgctccatggtgagcgcggtcctttttattttgaagtgagtcaatttggatgaaaatgtgccaatacattaagttgtccaagtaatcaccgcttactgtcttaatttaacgaaaagtccggaatggaagtagaattaaggttggcttctcttttcaaaaagcattcctatcgtttataattgaacagacagtaatcatggggagaaagattatgaacatttttaaaccaacgtggatgattgaaagaatttacaatctatccgctaaagatttaaaggccaagggaatcaccaccgtgttaaccgacctagataacactttaattgcctggaacaatccggatggtacgccagaattaaagcggtggattagtgaattgaaacgggaaggtattcgggtaattgtagtttcaaacaatagccacagtcgggtttccaaggcggtagctggctttgggttagagtttgatgcccgagctttaaaaccgttaacggtaggtattaaacgagttttacgacaatatcgtctaaaaaaggccgagaccatcatggtgggagaccaactccttactgacatggtagcggccaatttatccggagtacggggagtgctagtgaagcccttaattgaaacggatgcttggaataccaagttgaaccgttttttagagctattcattaagcggtctttgaagaaaaagtatccggaattagtttggcataaggagttattataagaatgaacgaagaagaaattcggtgtattgggtgcggggcaacgttacaaacggaagatgctcagcttccggggtacacgccggcgtcggccttaaaaaaaggtctagaaagcggacaattatattgtcaacgttgcttccggttgcgtcattataatgagattgcaccagttagcattagtgatgacgactttagaaagctattgagtcagattagtgattcagattcgctagtggtttacgtggtggacatgtttgactttaatggtagcttaattcccggactgcaccgttttgtaggggacaatccggttcttttagttggtaataaggcggatgttttccctaaatcgatcaaacggcaccggatgcgggaatggctacggcaacaagcaaaggctaacggaattgaaccggtagacgtgatgattaccagtgctaaacaacgtcctgcggtagaacaattgtttgataagattgaacaactccgcgatggacgtgatgtttacgtcgtaggggttaccaacgttggtaaatcaaccttaattaacagtttgattgccttacgcaacgggatcaaagacgtaatcacgacgtcccgttttcctggaactacgttagatcggattgaaattccatttgacgatcacagcaaaatgattgatacaccgggaattgtgcataacgatcagatggcacacgtgttaacggcggaagatcttaagtacatttcgccgaaaaagacgattaaaccgcgcgtttatcaattaggtgatgagcaaactttatttgcgggtgctttggcgcgctttgactacgaacattcaacgggctcggtcactgcctattttgataacaatctaatgattcatcgcactaagctagctaatgccgatcatttttataaaaaacacgctggagaacttttgacaccacctgcggcagaaaatctggccaatttgcctgaattagcacgccaccattttaagattgaggaagatagtgacgtggtctttgaaggtttaggctggattgcagttcccgcgggaagcgtggttaccgcttgggcaccaaagggtatttcagtagtaatccggcgggctctaatctaaaaacgaagtaccatcgctggtaagtaactaaataaagggagtattgatttgaaattaagaggaaaacaaaaacgttatttacgtgctcaagcacaccatctccgacccgttttttcggttggtaaaaacggactgaccaagagttggcttgctcaattaggcggcgcgttagataaccacgaattattaaagattaatttacagcaaaataccgacgtaacgactgccgaggttaaggagtttattgaacagcaaaccgacatccaagtcgtccaaacgatcggtcacgttttggttttgtttaaagtttctgcagacccagataaaagagagatttcagaaaacgttcaaaagatataatggtaaggtgattaatattgatttcgacaaagtcaaaaagtgtttcgggagttcaagtagaggtggttgaagaaccactaacacaagcaaagggcaagaaaattggcattttaggcggaacgtttaatccgccgcacctcgcgcatttaatgattgcagaacaggtggctagccaattaggattggataaaattctgtttatcccagattatctgccacctcacgtggataaaaaagaagcgattgctgcggagcaccgggttgaaatggttcgcttggcaattcaggggaaccctaactttgatttagatttaatcgaaattaatcgcggggggaccagttattcttacgatacggtcaaggcgttaaaagaaatgcaccccgaaaacgactactactttattatcggtggtgacatggtcaactacttgccaacttggcacgaaatcgataaattagcccgcatggttcattttgtgggggtcgaccggccagagtacgagcgagatgcgaagtatccgattatttgggtggacactccccattttgatttgagttcaaccatgattagggaaaaggttaataaagggtgctcaattaaatatttagtacccgatgctgtagaagattatataagggagcatcatttatatgagtaaagtagagttgacttacgaaaataattatattccgatgaaccgagaagaattggttgcggcggtacaaaaaagcgttcaaggtccccgatttgaccacatcttacgcgtagaacaaaaggccattgagttagcaaaacaaaatgacgctgacgtggaaaaagctagtattgcggctttattgcacgattacgctaaaaatcggcctgatagtgaatttattggttacattaataaattacaactggacccgattttgttagattatggtaacgcgatttggcacggagttgtcggagcagaaattgtcaaaaacgaattaaaaattcaagatgaagaaatcttaaatgcaattcggcgacacacggttggagcaccatacatgactttaattgaccaaattgtctttatggccgattatattgaagacggccgggattttgacggggtgcaacaagcgcgcatcattacggaacaaagtttaccaaagggcgttgcgcttcagatgaagaatacgctggcttatttagtagccaacaatcgcccggtattccccgccaccattgacagttacaacgcgtggattgcaaaacttaacgactaaggagaatgaaagtggataacaaacaaagcttagaattagtagtaaaagcagccgatagtaaacgtgctgagggaattattgccttagatgtacacgaaatcagcaccttggcggactatttcgtgattactagcgcggactcaaatcgacaagtagcagcgattgcagacgcaattattgaaaaagcaaaagaaaacgacgtagaaattcgtcgaattgaaggttaccgggcggccgaatggatcctcattgacttaggtgacatcgtaattaacgttttccaaactgaccaacggaagttttataacttggaaaagttatggtcagaagctaaaaacgtagaaattgcggattggattactgaataatgatttaccagagctttgcggtgctttatgaccagttgtttgatgaagaacagtaccaaaattggtttgaatataccaaacagcaagttgatttgaatcaaacccacgaatggctagagttagcttgtggagccgggcgcctggcggttaagttggcaaaacaacgccaaaaggtgaccggttttgatttatcaagtgaaatgttggctttagcggaacaacacgcgtattctgcaaaagttccgttagaactggtccaggggaatatgcttgatttagcggaattacccacctatgacgtgatttcttgctacgccgattcgttttgctatttagcaaacgaaattgagttattgacggcctttacgcaggtgcacgatcacttaaaggaaggtggtcaatttatttttgacgtgattactccttaccaaacgggagaagtatatccgggatacatgtttaattatcaagacgaccagcaggcttttctttggactagctatgcgggtgaagatcaataccatgttgaacatgatctaaccttctttactaagcaagatccaacgtcagacgcgttttaccggacggaagagacccattttgaacgaacctacgagttagatacgtacgttggtttattacagaaagcgggcttttctgcggtgaagtactttgcagattttggtaacgcgccggtagatgaacagactacgcgctggttttttagctgcaggaggtagtagaatgcgggcttgtgcggtaattgcggagtttaatccgtttcacaatggacaccagtacttgctgaaaacggctcggaaaacttcccaagccgacgtgatgatcgtgataatgagcggtaatttcgtgcaacggggagagccggccttaataaacaagtgggaacgggcagccgtggccttgcaaagtggtgccgatttagtagtggaaatgcccactgagtacgctgtggcagccgcgcgagattttgcccaagcgggagttcagattgcccagtggcttcgagcggatgcgttagcatttgggtgtgagacccctggattagattttcaagcacaaagtcggttacttgaccggacttttagcgagcaagattataatcaaagtttcgccagtcagctgtttgcggaaagttcgttaagccggtctaacgatattttaggggttaactatgcttattggcagttgcggctagcacctaaattaactttattgcctgtggaacggttgcaagcggggcacctagaccaagaaatcaagggcacgattgccagcgcgacagccattcgtcagtcaattcaacggaatgatgctcagtatcaacaagcggtacctgaccgaatggaaaaggtgttagaacggcaaaagccggttgattggcaaacattttggcccttcttagagtaccggttaaaaacaacttctgctaaagaattacgccaaatccgtggaattaacgaaggcattgaaaatcggatccttgcccaagcggcacaaagtagttcctttatggaattaatgacaaatttaaaaaccaagcggtatagctatactagcttacaacgcaaattaaccgctattttattaaacctgcgagcactgagtccgttgcaaaagactcgtctgctggcggttaatgctcaggggcaagcctatttgcgggaacacgattttcgtgaagttctgatgactaaggtaacaaaagcagattttactgccagttatcagctaactaagcgcgcggatgagctatatcaaatggtggcgccttatgaatggggaaggacgccgattttagaaaagaatgtcaaggaaaaaacgttgacaaagaaatcctagatggtataattatttctgttgcattggaggttcactatggaatggtattttacagaattgcgtaagcataaagaaccgtttcagttcgatgagacaatggatttggaacaatctttaatcgaacgctttccagatgtagttttaaaatgctcaccaatcaattttaaaggcaccgtgacaaacgaccgggattcagttatgattgatgctgagatcagttgtgatttaacggttccgtcgtcgcgttccttaacacctgttcacttaaagcttgacttttttgtcaatgaaatttacttggatagtgctagtttgattgacacgttcccacaagaagaagtggtcatgttagtcaaggatgacgtaatcgatgtcgataagttggttgaagacaacgtagttttacaagttcccatgcaggttttaacccctgatgaagaacagaagggcactatgccatctggtgcagaatggcaagtggtttcggaagtagccgcggagtcggagcaagataaacaagttgatccacgccttgcaaagttaaaagatttattgaaagataattctgatcagtaaggctttaaattaagcgggagaccgtaattctcttaaaggaggtgctcattgatggctgttccagcaagaagaacatcaaagacacgtaagcgtaatcgtcgtggacacattaagttaactactccaggtttggcaccatgcccaaactgtggtgaattacgagtttcacatcgtgtttgcccaagttgtggttactacaacggcaaacaagttattgacgtgaaagctaactaatgattaaaaagcaacaaaaggagcctaggtccttttgttgcttttttgttttaaacttctttaatcaaagtgatttttttggtagtattaattcgacagagtcgttgtcaaagaggaggaatagcaacatggataaaccacaaattggggtcattggaatggccgtaatgggaaaaaatctcgcgttgaacattgaaagccgcggatacacggttgccatctacaaccggacggctgctaaaacaaaacaagtaatggaagatcatagtgataagaagttagttccttcttacacgattgaagattttgttaattcgcttgaaaaacctcgtcggattatgatgatggttaaggctggtaagccaactgacgcagtgattgctgaactcttgccgcttttggataagggtgacgtgttaatcgacggtggcaacacttactttgaagacacaatgcgccgtaacaagcaacttgatgaatctggaatcaactttatcggtaccggagtttctggtggtgaattaggggcgttacaaggtccttcaatgatgccaggtggtcaaaaggaagcttacgaccttgttgcaccaatttttgaacaaattgctgcaaaagctaaagatggtgaaccttgcgtaacgtacattgggcctaatggggctggtcattacgtaaagatggtccacaacggaattgaatacggtgacgaacagttaatcgacgaaagttacgatttaatgcgtaaaatggttggtctttccgttgaagaaattgctgacatctttgcagaatggaataagggtgaattggatagttacctaattgacattactgcagacatcttaacccggaaagacgatcttggcagcgacaaaccaattgttgacatgatcatggacaagggtggtaacaagggaactggtaagtggagttcccaaaacgcccttgaattaggggttccacaatcattgattacggaatcagtttatgcgcgttacatctcggttctaaaagacgaacggattgctgcaagcaaagaattgactggtcctaatccaaaactcgatgtggacaagcaggaaatcgttgaaaagattcgccaagcgctttacttcagtaagattatgagctacgcacaaggatttgaacaaatgcgggtagcttctaagcactacgactggaaccttaactttggtgagattgctaagatttggcgtgctggttgcattatccgtgcccaattcttgcaaaacatcaccgatgcatttgacaagaatccggaactaagcaacttattgatggatgattatttccaagaaattgcaaagaagtaccaagatgcagttcgcgaagtagttgcccttgctgttaaagcaggtatcccggttcccgcattttcagctgcggttgcttactacgactcttatcgctcagaagtacttcccgcaaacttattacaagcacaacgggactacttcggtgcacatacctacgaacgggttgaccgtgacggcattttccattactcatggtatgaagaacaatagacttagataattaaaaagaactgttcgcgagccttgacttaaatatccttgaagattgggagtaaaaagttggggaatttgcgagcagtaactggaaatcgatcgttatgcctcaattgggcataagggtcgatttttggttaagtgggaaaaactaacttagggcacacgttgtgacttcattaaaattatcacacaaatgtttttagtcgctgcttaatttttgggtcggttttgaataggcgtattcgctattgcgacggccagaaagaaaaatgcatacctccaacaaaaacgcttgtcagcaacttagagaactgctaggcaaagccagttgacaatgttaaaatttagaagtatagagattaaaataatttaattttggagcggaaaaaatgagtaaaattttgataattgaagatgaaaagagtttggttcgctttgtagagctagaactacaacatgaaggatacgaaaccgaagtccaaggaaatggtcggaccggtttagaagccgccctttcagaagactttgacgcgattttattggacttaatgttgcctgaaattaacgggattgaagtttgtcgccggattcgccgggaaaagattaccccaattattatgatgacggcacgcgattcaattattgatcgggtgtccggattagaccacggtgccgatgattacatcgttaaaccatttgccatcgaagaattgttagctcgtttgcgtgcggttcttcggcgggttgacctcgaagaacaggatacttctttccaccaaacgactgtagaatttaaagacatcgttattgaaaaggaaaatcgggtcgttaagcgaaataacgaggtaatcaatttaactaaacgtgaatatgagctcttgctacttttaatggagaacgtaaacgtggttcaatcccgggaaactttgttgagtaaggtttggggtttggaagatggcgtggaaaccaatgtagtggacgtttacatccggtatttacggaataaaattgacgtggcagggcagcctagctacatccaaacggttcggggcaccggctacgtgatgaggacctaagatgttgaagcaagcaattcgtaatcaacgggtttccctaaaatggaaatgggcgatcggcaccggtgtcggagttttggtaatttttggcctgttttcgtttttcttgtttaaaattttaaccggctcactttactccgtagaacggcataacgttgaaaatacaattagtcaggttaacgaccggctccgcagtgctcaggttatcaattatcaaactaccaatatttttcggcctaattttaacgaaaagtctacggagcaccaacaccgggtttttgacgataatttgctagctaatttgacgcgtaaggatttggcagtgaccgtttatgatttaaatgggaaaaccgttttttctaaccagcgaaatccgttgcaaatgaaaaaagtcagccaccgggtggttaagcaccaaaagtaccacgggcaaaaaattatcgtggggcaggctcccatcattaaccgaaataagcaaaaaattggctatgtggaagttgtcaacctgcttagggactacggacgcaattaccaccgcttaatttggttgtttgggttgacctcgctgctggtctttatgattatttcgattttcgggtatggtttagcgtcttacctgctccggccaatgcgctccattaacgtcacgatgcgggaattagaaaaggatccgcaaacggaatctcgggtaccggttttgaacactaacgatgaattggaggacttaagccaacaatttaatagcatgattgatcggatgcaacgctatattgaccaacagcgacagtttgttgaggatgtttctcacgaattgcggacccccgttgccgtggtggaaggccacttaaagatgcttaaacgatgggggaaagacgatccgcaggtactggaagaatcgattgagtcttcattggaagaaactcagcgcatgaagagtttggtcagtgaaatgctggacttaacgcgcgcagaccaaatcgaaattaattacccaaatgaaaagaccaacgtggctcggctcgtcaaccaagtttttaacgactttaagatgatccatccggagtttcagtttacgatggacaatgagttgatcggggagccgattgtgcaaatttaccgtaatcacttagaacaaatactggtgattttactagataatgccgtaaaatactctcgagaacgtaaggaaattcacttgtcgattgccaacactaagcaatttgttgaaattgcggtgcaagactttggcgaggggatctccgaaaaggatttaaagctcgtctttaaccggttttaccggatcgataaggctcgaagccgggatcaaggcggcaacggcctaggactgtccattgctaaaaaactgattgaggaataccacggaacgatttcgttagaaagttcggtgggatcgggttcagtatttaaaattgaattgccaattctacaaaacccgggctacgaccaaaattattaaaaatgacgaactaagcgcttttccaggattttactaaaatcctggaagggtgcttttttgttgcaatttttggctttaatgaaccaactaagggaaccttgcgggtaactaaaccgcaaaatagacctggagttttgcaatcgaatagctgtgccaacgatattgtaagcgttatcaaacggccgcagtatataaaccatagaaacgtttctaagtcttttaaaaaaacgggttagatttgattgaggagttgaagaggatgggtgaacaagtaaccccaaaaatggatcgtaaaacgttttcgttggttttagttgcgggaacggcgtcttatttggactctagtttgctagttagtttgggagtagctttaccaatttggactcgaattatgcacttaagcccgttgttatccgggttaatttcgaccttgttaactttgatggtagcgctgggtgccgtagttggtggatggctagccgatcggtttggtcgagtccgtgtgtttaatttagatattttattcgtggcggtgggggcaatcattattgcattcgcccctaatttaccaattttgctaacgggaaccatcgttgcgggaatagcttcgggggcggacttgcccacctcgttagccgtaatttcagaacgaacttctgacgcaatgtatggccgagcaattacgattacccaaatcttttggacggttggcattttgttatcgcaatttttaggatttttaacttcggcaatgacggtcggttcggtgcgggtaatctttagcgtaattgctttagttgccctggttaattggtcagttcgggtcttttctccaaaatttaaaagagtggaagattcgttggtggacgaccaaaaagcgacttttaattcgcagaatggtcagccacgggttaaactaggcgaaattttaaagaatccggcttacttaaagattctagtggcgttaacgatgttttatttattttggaacctgcctgctaatacgtggggttctttcgtaaattattttttggtgacggtttcgcaccgcacccaagcatttgcaaccttggttgccttaattgctaacgtatttaatctggcatcgaattccatttacgtgaaggttgcggacaccaagtaccggtatccagtaatgggaggagctattttaattggggcggtatcttttttctgtgcgggagtttggagcgacgtttggtgggcctttgcaattgcgtacgtttgttattccgctacaaacactttgtgtggcgaaccaatttataaaatttggacccagacgttctatccggtagaagttcgcgcttccattaccggcttttcatatggattcgtgcggctatgcacggcaattttttcgctttttacaccgacgttaatggcgtggtcagtacaaaattttttatggataatttttgcttgtgcgttaatttcaggtgccttcgcaattgggattgttcaaatgctacggcgccggaaaacgcgttagaagggagataaaatgaatcaaacttattggatttggtatcctggagattttgcaattcaccaaggaatgctacagaacttttctcgtgaagaacgggggatgcaatggccggcatactggtacttagaggattgttaccggaacgtaaagtttttaaaaacttaccagcttaaaaacgcaactagttttatggtgtgtagccatcaaccgggatacgtaacggtcaatgaacagaagtattcgttaaacgaaccaattaatttaaccgcaggggaacagcaaattgttatctacgtatttagtgctaaagacttaccctgtgtatacgttgcgggagcggaaatttattccgatgctagttgggttgcaagtaattatattcaagaacatccagtcgggtggagtgcaatgtttactagcaacacggatgatcctaatcaaatcccatatcgatgtcgagaaacttttccaaagcaaattgttgagcgagctggcggaaagttaattgattttggtagggaaattaatgccaccgttcgttttactaaattaagccacccgatccaagtttgctatggagagtcagtagccgaagctttagataccgttaactgttattatcagcaacgcgatgtaagggaaaatgaagaactgactaaacgggcgttccgttacctatttattccagactatcccgatggacaactagaagctgtagcgactcaaatcgacttaccaatgcaaaatcacggcatttttaaatcggacgaccctttgcttaaccaaatttggcaagtttcgttacgcactttcaaactatgcagcgatcttttctttatcgatggcattaaacgggaccgctggatctggggcggagatgcttaccaagataactttattaaccaatattcattttttaacgaagaggttgaccgacgaaccattttagcgttacgtggccatgacgaggttcaccaacacattaataccatcgttgattattcgctgttgtggattattagcatttacaaccattacgaaatgtctggagatcgtgattttttgcaaatgattatgccccggatggagaagatgatggattacttactagcacaaaccaattccctaggcttcattattggtcgatcacaagactggatctttgtggattggtcgccaattgataaagaagggccggttgctgctgaacagatgtttttattgcaagcgttaaaagcgatgacggtaactaagaaagtcttgggaaaaaccgcggatgctcagcattatcagcaacgctttgaccaactaaaacaaaatgtctggaagtatttttgggatgaagcaagcggggcgtttattgatagttatgaatctaaacggagacatgtaacccgccatgctaatattttagcggtcctttttgcggtggctgatcgcagacagcagcagttaattttggaccgcgtcctcctaaacgatcgggttacggcattgaccaccccgtactttaaattttttgaacaagacgctttgtgtaagttaggacaatatgaccaagtgtatcaaaccattaaagaatactggggagcaatggttgaaaagggggccaccaccgtttgggaagagtatgatccgcaggtatcgggggatgcccagtatgcaatgtatggcgaccctttcggaaaaagtctttgtcatgcttggggagcaagtccagtttatctactggggcgctattttttcggattacgccccacccaagcgggttacgcaacttttgaaatccagcctcacctagcttattttcaaaaattacacggccagttgccaattaaagacggcctcgtccattttaaagtaagccgtggtcaactgaccatcacgtgcgatcgtaatgggggaacggtaattagccaaggcaaacgaattccgttgctggccaatcagcccgtagtaattcccattgcgtgacggatgattgctagcaaaaaagggggttaaggggattcttaaaagctatttggttagtttggctttaatagagccaaagtcagtttgttccgtttaaccaaaaaaggaccgttatgcccgaatcggcataacggtcccttttcaattaatgcttgcgaactacctgacttcttttaaacatcccattagtgatgatgccgttgttttccagcattccgctggtgattaacgttctttttggttgaattagtagtagtctttgtggttgctgcttgcggagtagtttcggttggcttagttgcgtccgaagcgtctgcatcgtccaaatctactggaccagctggtttaataatctttggaggattctttttcatctcttcatgaatttgagcccggatccgcggacggtagaagttgattagtaatgtttggatacatgcgaatactccaccaaccgcaaagtaaagtcctaacccagcaggcgtagagaaggtgaagaacaaaatcattaacggactaatgaccatcattgaccgcatcgtcttgcgttgttcttcaggaaccccaagtgttccaagccagccttgcaggaggtaaaccaagaatgaaattatggacaataacaaacttgatttggaaaggtcaattcctaagaaaattccctggtgcaattcaggagaatattgaattgcggcgtataaagcagcaaatactgggaattgaattaacagtggcaagcaaccgatcccgccagtcatgctaatgttgttatcccggtataaagccatcatttcttggctgaccgcagctttttcttccggcgttttagcagtttgattacgctcttggagtacttttagctgaggttggatgtaagacatcttttcttgttgaacggttgccttacgggactggttaaccatcagtggtaataaaatcaaccgaactacaaaggtgattaagatgattgccaaaccataactcccgccaactaaatgggagaggtagtccatgaagtgttgcattggaactgctaaattgtcatagataaagccataagggtggccatggctgtcgcgttgaacacaaccgcttaagaccaatcctagcccggcaattaaactaactgtcgagattcgttttatttttttcataatctgcgtatggttcccttcttacttataaatactagaaatacacaagggttactatacttgattttgcccgctttttcaacgtactttagtatttaactaaaaactcgcgagcctgaaacgacggaatttccttgaccactaatttatccacccgcccagaaggagaaggagatgctttaaccccttgaataaattgctttaagatctcatttggtccttgagcctcaatttctaccgaaccgtcgaggctatttttgacccaaccggtaattttcagttgatccgcaaggtgtttggtcataaaacgaaaaccgactccctggacgcggccgaccacgtgcatgtgaactgcttgcataacgttcatccctttcgtcgttaacttacaactataattttatcattttcaactagctaagcgagttattagcacgtatatcaatttgccaagcttaatgataatataaaaatggcgtaagtgtgttatacttacaattggtaaggagattagataatgttagaaaagatttcttctgtaaaaaattccaaggtaaaggaatgggtaaagctaaagactaataatggtcgcaagaagtaccgccgtttctttttagaagggcgtcatccggtagaaacggcgctcgttgaagaacgtcagtacgagtatttaattgtggaggagggatttgacctagcaagcttagaagctaacgttgacgaagataagttaattgtggttactaaagaagtgtctaagcacattgccgatacggtacacgagcagggaatctttttgattggttacgtggacgatgcggtttacgaaatgcctagtgacacgacggggcaatggctgctgttggataacgtccaagatcctggaaacattgggacaatggtgcgaactgctgacgcggctggatttactggcgtgatttttgggagcggaaccgctgacttttacaatccgaagattctacgggctatgcaaggcagccagtaccatttacaattaaagcggcttaacctacaaaagtggattgaggcttgccatcaagctcatcaagccgtttacggttctattttagacgagcatgcccaaagttaccgagacatcgatgctccaaaagatttttccttaatcatgggtaacgaggggaacgggatgagccctgaattagttaaggctaccgattgcaacctttacattcccatcaaggggaatgctgagtcattgaacgtggccgtggcggcgggagttttaatgtttggtttagttagttaaggtttggttacattttcggttaatttgcgtaaatggcttgattaaaaaaagtttgcagttaatattagagtaactaactagccaaaaggagctttagatgaaggtattggattgggaaaatgatgcacaatatttagatttagtcggcgatttacttgaaacagacgaagtacaacgattgaaaaactatacgcagcatcataacggaacccggttggatcattgtatccgggtatcctatgaaagttatttattggcaaaaaaattccatttagacgttcgctccacagcgcgggcgggattattgcacgatctgttttactatgattggcggacgaccaagtttacgcttggtacccatgcatttatccatccccgggttgctttacgaaatgccgaaaaaattactactttaaatgacaaagaaaaagacattattttaaagcatatgtggggagctacaattgctcgtcctaagtatgcagaaagcagcattgtctctcttgtagacgatgcccaagcagtaagtgaatatacggaccacgttcggaaaaacttgcggcttaaattattagagtataaaaataaagtgattaagttgatttagttaaagaggtttttgatatgcaaaacgtacaccaaaaaacaccaactgattttgaactttgtccaaagtttgaacacctatttgatattttaggaaagaaatggaacggtttgattttagaagtgctgaccagtgccggtccacaacgttttcgggacctatcacgttcggtaacgaagtgcagtgaccgggtgttggttgagcggttaaagaatttggaagaagaaggattggtcgaacgatgtacctatcaggattcttccttaattgagtaccgcttaactgaagaaggcgaaggactccggccagtcttagaagccgcgcataaatttgcggattgttggtactaattgactattgacctcggcgaggattttagttaaagtagctaagtgaatacaatatcaagctagaagagtagtagccggttgagattagtagccagagaagaagggaaagctgagaaccttcgatactagttgcggtgaattcgcttcgttttagaataggcgggtcggccacccttatggggctaaccaagtgtgcaagtaattgcaaacaagggtggtaccgcgtttaaaacgtcccttttttagggggcgttttttctttgcagaaaggtggaaagattatgggtttacaggacaagttaaaagaactagaagaaaagggcctacaagaaattaaggtcacggatgagttatcaaagttaaataaaatccgggttaacttattaggaaaaaagggaccgttgacggaaatcttacgggggatgcgcgatttaagtaaggaagaacggcctaaagtgggccaatacgctaaccaaattcgcgataacttaaaggaacaaattgaagctcgaaaggcggagttagaacaagcggccctcgaccggcaattagctagcgaaacacttgacgtaactttgccaggctcacccgttcgccagggccaaccacacgttatccaacaaatcattgataacttggaagacctcttcttaggtatgggttaccagattgtggaaggtcccgaagtggaattggatcgctacaactttgagatgttaaatttacctaaggaccatccggcacgcgatatgcaggatactttttaccttactgacgaagtcttaatgcgttcgcaaacttctccagtacaagcccggacaatggaaaagcatgactttagtaagggaccgctaaaaatgatttctccaggcgtggtttaccggcgggatacggacgatgcaactcattcgcatcaattccaccaaatcgaaggattggtaattgataaaaacattaccatgggtgatttgaaggggaccttgattacgatggcaaaggaactatttggcgatcgttttgaagttcgcttgcgtcctagttacttcccattcaccgaaccatcggtagaagcagacgtaacgtgctttaactgcatgggcaagggttgttcagtttgcaaaaataccggttggattgaagtgctcggtgccggaatggttcatcctaacgtgcttaagatggccggcgtcgatcctgaagaatacggtgggtttgcctttggattaggtcccgaccgatttgcaatgttgcgttatggagttgacgacattcggaacttctatttaaacgacgtaagatttttatcccagtttgacaagcgaggttagttaacaatgaaactttcatatcaatggttatccaagtatttggatttaagcaacatcgagccgcaagatttagctgaaaaaattgagcggactgccgtggaagtcgattcggttacgcggttagattataaattaaagaaaattgtggtgggccacactttggaagtggttgatcacccagattcagaccacttacatatttgccaagttgacgttggcgaagaagaaccaatccaaattgtttgtggtgcgcctaacattgctgcggatcaagacgtcatcgtggcgttacacggttcacgaattaaagacaacgttaaaatcaaacgcagtaaaatgcggggtgtcccttcaaacggaatgatttgcgcattgcaagaaattggttttccggatagcgtggttcctaagaaatacgtagatggcatttacgttttcccagctgatagtaacgttcatcctggtgattctgtcatggaagttttagggatgaatgatgacgtcatcgatacttctgtaactcctaatcggggggacatgttcagtatgaacggaaacgcgcatgaaatcgcggccattttagaccaaacggctcaatttgaggcagttcccgaagtaaccagcgccacggatgcaaaattaagcggccaaattaaggttgagattgccgatgatcaacttactccggtatataaaatgcgtggtattgaccaagtgaaggtagccgacagcccattttggctccaaacccttttaatgagggtcggtattcgaccaatcaataacgtagtggacgttactaactacgtaatgttgaagtatggtcaaccattgcatgcatacgacctcgaccaattgcaaggcaagacggtgggcgttgctaaagctgaagcggacacctcatttaccacccttgatggcgaagaacgacagctccgtgatgaagatttagtagtaactgcagatggccaaccaattgccttagcaggggtaatgggcggcttgacttcggaagtggaacctactaccagtcgggttgtgctagaagcagctatttttgatccgatcaaggttcgtaagaccgctcgtttccataacttgcacagcgaagcttcgatgcggtttgaacggggaattgattacggtgccgtaacggatgcgttgaacgaggcaattgccttgattactgaatttggtaagggccaagcctatccggatgaagtcgtgggcactgcaaccactaaagaaccagtcaaggtagcaattacgttggctaaaattaaccgggtgttgggaactactctaacgattagtgaagtcgaagcaatttttgcacgacttggttttgctgtaaccactgatgaaaatgcggaaatgtttgaagtaaccgtgccagtacgccgttgggacattcatttacaagctgatcttctagaagaaatcgcccggatttacggttatgataacctacctgtaacgctaccaaccggagctccaacggtaggtcaattaaccgaaaagcaaaaaatcatgcggaattcacggcagattttagaagggcttggtttaactcaagcaatgagttatggcttaactacggttgccaagagtcaaaacttcttaaagcaaacgactgaaccagttaaggtagcttggccaatgaccttggatcacgaagctttacgaatgaatttagttagtgggttgttagacgacgttgcttacaatcacgcgcgctttgttgacgacgtggcgctatatgaacaagggcgggtcttttattcagttgaaggacaagctcaaccacgagaagtggaacatttagcaggagcaattaccggatccttacaagcaacgacttggaaccaaccgcaacaaaacgtttccttctttgatgccaagggaattgtagaaaagtacctccaaaacatggcgttagaaggccagattaaatacgttgctgaccaagatcgcaagggaatgcacccgggtagaactgcggacatttacttagacgatcagcttattggatttgttggtcaagttcacccaaccactgcgcaagaatacaagatcaacgaaacgtacgtatttgaattgaacttaagtaaaattattgatgcaccaaagcaaatgcaacattacgaagtgatttccaaatatccagcaattacccgtgacgtggcgttactagtggctgaagaggttactaacgaacaagtattagacgttattcaaggcaccaagcaaaaatacctgacggacgttaaattgtttgacgtttatgctggacatcatttagatgcgggaactaaatcgctcgcctaccaattgacctatcaagatcgaaatgctactttacaagaggataccgttaaccaggaatttgcgaaggtagttgaacaattagaaacccaattaggagcaacaattcgctaaggattacaacttggtgactttaatgcacattaagggataattttgtataattaccagtattgtaaacgataggagaatgaaatcttgaataataacagcaacgattctaatcaaagtcggcggaggcggactgataatagtcacgctaataaaaacagtcatcaaattatcaagtgggtaattagtattttggcggtagtaattattattactaccttcatgggctaccggtactatagctcttcacttaaaccattaaacccgcaaagtaataaacagattgaagtgaacattccgattggttcaaccgctcgggaagttggctcaatcttggaaaagaagcaggtggttaaaagcggagccgtctttaactattacacgaaaaagcaaaagttgaataattttcaagctggctactacgttttaaagccttcgatgactttaaagcaaatcgctactaaacttgaaaaaggcggagcggctgaaccaattgcgctaaacggaccgcggatcttaattaaagaaggcgaaaacattgatcaaattgccgattcaatcgccaaagattcgaaatactttactaaaaaagacttcttgaagttgatgaaggatgaaagtttcattaagcagttagctaagaagtaccctaagttgttaggttctgcaatggatgcgcagggcgttcgttaccgtttggaaggttatcttttcccagctagttattcagttagcaaggataccagtctaaaagacgtggtcacccaaatggttgcaaaagaagatgccgtacttcaaccttactatggcaaaatcaaggaaaagggcttaactgtccaacaaaccttgagcattgcgtcattagtagaaatggaaggtagtaaagctagcgaccggactaagattgcgggcgtatttttgaaccggattaaacaaggtgaaacactcggttctgacgtttcgacccgatatgccgtaaagaaatcggctacggaaaatctaactgcatcggatttagcaaacccaagcccatataacacccgggtaagcaccggttatatgcctggtccggttgataatccaggcgaaaactcgattttgtcagtaattaatgctgatactaaagatggatacctatacttctttgcggtaactaagaagactggtggccataaagttggcgacgtcttgttctataaggactttgataagtttaataatgacgtggcaaaatacaatccggaaggtaaatagtgaggaattagattaatgagtacgaaaaatagtccaattattattggggtaaccggaggatctggaagcgggaaaacaaccgttagtaagaaaattcttgaacaacttgatggacactcaatttcaattatccaacaggattcttattataaggatcaagcgggaatgactatggaagagcggcgtgcggttaactatgaccatccgttagcttttgattcagatttgttgtatcaacatttgaaaatgctcaaacagcggcaggcgattgacgttccggtttacgattatacgatttcaacccgaagtcccgaggtgattcatcaggaacctacggacgtggtcatcttagaaggaattttgattttaagcgacgaacccattcgtgacatgctggatatcaaggtttacgttgatacggatgacgacattcggattattcggcgtattgagcgagatacccaggaacggggacgctcgctagaatcaatcattacccagtatttaaccggggttaaaccgatgtatcatcaattcattgaaccaactaaacgctatgctgatcttatcgttcctgaaggtggggaaaatagcgtagcaattgatttgttagtaaccaaagttcgcgatattcttgcacatgcaggtcgcgaccgacaatataataaataatttttgaggtgaaagaatggcagacgaaaaaagatatccaatgaccttggatggtaagcaaaagttagaagaagagttagaaactttaaaaacggaaactcggccacaagtaatcgaacggattaagatcgcccgtagctttggagatttatctgaaaactcagaatatgaatcagctaaggacgaacaaagtatggtggaaagccgaattaacacgattgaacacatgcttcactatgctgaaattatcgatgacgaagcgattgatagtaacgaagtttccctaggccgggttgtagagttccaagaacttcctgatgaagaacccgaagaatacaccatcgtgggtgctgctgaagcagatccgatgtctggtaagatttcaaatgattcaccaattgctaagggtttgttaggtaagaaggttggcgacgtagtcacaatcgctacaccaggcggcgatatgaaggtgaagattttgaccgttaagagtgcggagtagtttttaaactttcaatatatcaatgataaaaaggactaaatcttgaggtgttactcagatttagtcctttttagttagtgttttattattaacttagctaggaaaataaaagggagattagggtccttgtggattctaatctcctttgagttattttttgttttatttatttacgccgcgatttttgccaccacagtttgattagtaaacctaaccaacccagaagggtgatgatagttcccattcctagtaaaggagggtaataagtgagcttccattggtgagtgcctgacgaaattttgtctgcactacccaagaagtggttggcaactttttgggtggcaaccgcgtggccatctacttttaagtgccagcccggactatatgggatcgaggtaaacaggtacggccgctttgtagttgccttaagctttcccgtaaccacgttgccgttagcttgtacatccgtaagctggttattttgtgcaacgtgatctaactgtttaaatttagcaaaatcaagttgataaattccaaaatcagacattaatagggtcgatttctttagcacaatttgaattcgcacccgcttaccgcgactatggtcggcaactgacaaaacaattggatggtcgtagtcaatgtcttcggtaatgcgttggttattaacgaaaatgtcggcattatgatagttcatctggctgccagcggtaatgtagagcggatcgtcagtttgaggaaccacttcaaaagtaaccgaggcacctttatttagtttttgtttattaagcactgcgttccggacgtcagccgaggtgctgacgttggaataataaatttgtgcagtgctggtgaggtcgtcgaagaggttgaccttactttggccacccaacgcggtcataattgcgttttggtactctaacggacgataggctggtaactggttggtaactggttgtgaagtcatcgtccctaaactaattgcgtaagggttacggtagttatttgcataccgagttttatcaaagtaatcataacgctgtaaaatatcgtgccggacgctccgggttaaaaacggatttttcttaggctgggcgtcaacgagcgaccaggaacgaaagtctaaaaatgcgtctgatagtaaagttccgttcatataggtaatgtttcccgaagtggtcggttggcctaaatccgccatggcctctagggaattagtttctaagttagaattaaaactagctccactgttaaagcctaactgaatgggatcgttttttgcccggaagtaattagtaccaatccgctgaaaatctgcgggatgtttttggatttggcggagagctttccgcgctgcgacactataagtttgaaattcactttggctaacgtagctgatgcggtttaaagaccaaacggcattaatcccaacgtcgaggaccattaatccaagcataatcgaacgcaacgccgggttggaatttgcactctgtaagccaacccatagtagcaaagcagctatgaaaaggatcccgcctaaaattaattggtcgttagataaaaagtcttgcgattttggcaaaaactggatacctgccagtaggattaaacatagtcctagtagactagtgaccagcggagctaatagcttattttggagaggataaagcatcccccgaaaggcaagcatcatcatccaaaagctaaggataaagctgaatcggtaagcataccaccacggaaattgcattgcgtgccaaagtaaatctagtggtgaccagcaaaatgacagcaagaagattgcagtgattgccaaggcacttaagcgttgagaaagtttaatttggtggttaaagaagtaggcgattaccgcaattaaaattaccatcccgacgtaaatgtttggaagtccctcggacatttgtttaaaactaaaggttcctggaaatagcttcaaaaccatcttgagcggattatattcaaatttccactgcaaggtgttttcagtgtagttcgcctttccgtgtaaaagtgcccacaaagtcggcatccaggtcaccgcagaaaagattcccactgccagccaagcctgcacaaaggaccatgccttacgccaattgaggtggggactgcgccacagaaaatacatcaccgtaaaaattccaatcatgtacgcaaagtaatagttaataattatcatggcggtcatgctaattacaaacaatttaagcttgcgatcggcgataatttggtcgattcccataataatcagtggcaataaaattggagcatcaagccaaaaaaggttgagctggtttgcaattgaaaaggccattaaactataggaagtagcaaaacctgccacactaagccggttaggatttcgtccaaggcttcgtgcaaggtgatgcaaataaagcgctgcggttaagcctgccaaagcatacttgactagggtaacgattaggatcccggtagtaatactttcctttttaaagaaaagcagtattaaattagttggacttaataaatagtaggcccaggtgccgaacatgtcactcccaaggccgttgctaaaggagtaaaaaagttgacccgggtgtcctaaaatagtttgccgaaaatattcataaaaagcgacatattgctggcccatatccacggttagtaagctcgagctaccaaatggagcaaagccccggtaaataaagtaggtgagcattactaaagcgggaatacagctactgagcaataaatcacgtttttggttattaatttgcataaagatcccccaagcaatttattaatagtattaggatagcataaaacatctttaagactttactaatcagttagtgaagtggcatattttctggtagaataaacgaagtgatttaactaaggagtaatatgtggacatgaaaaatccgaagaaaaaatttcggcggcaaaaaagtgaattaccgtttcggttaaatttaatcttttttggtgtctttgcgttattgttattattgattggccaattaggctatttacaaattttgtacggctcaaagctccaagccgaggttaaccgttcggataacatggtagaaaccgaaaatgtacaacgcgggatgatttacgattccacgggtaaggttttagtgggaaataaggcgcaccaagcggtttcttatactaagaatatgaacgtcctaccgcaggatatgtacgacgtagctaataagttaagcaagtatttaacggttgaaaaaaatgaccttacttcaactgatattgcgaactatcttttagctgacagtaaaaatagtaaagcgtacgcgcaaaaaattactaaccgggaaaacctttctagtaaggcattgcaagaaaaagagattgccgcggtcaaaaaggatcacgttgaactgactgctcggcaaaagaatgccgcgcgaatctataaaaccattagcggagcttaccagttatcgacggtttacattaaggagactgatttaaccagcgaggaactatctcaaattggggaacacttgtcagagatgccgggagttaagatcactactagttggacccgaaactatcctgctggcgatgacgtaaagtcgtttgccggaacggttagcagctccaaagtcggacttcctagcgatgaagtgaacaccctcttggcggaaggctatgctcgtaatgatcgcgttggccaaagctaccttgaaaaacgttatgaaccagtactgaagggtactaaatcgcagacttctgtggaagttagttcgggcaaccaagtggtaaaacgggtgcaaaagtacgctggtaagaagggtgataacctagttttatcaattaactctaagttccaagaagaagtgcaaaaaatcatgaaggaagcttcccaaaacgcgggcggcgagtcaaccggcggttacgcggtggtaatgaatccgaagaccggggcggtaattgccttggccggagtagatcgcgatccgtcaaccggtaaaatcaccgataacgccctcggaactattaacgagccaattgtaatgggatcggtggtcaaaggcgccatggtttccggagccttaatggacggggtaattactccaaaagacaataccctgattgataagcccattaagttggcgggaacgggttcaaagagttcgtggttcaacagtacgggtagtgcgaacatgccggttgacgtatcgaccgcgctagaagtttcttcaaactcctacatgatgcaattagccatgaaggagggcggtttcaagtacaaagaaggtgcaggattagctgggatgaatccgaccgtgtttaacaaaatgcggggatactttgaacagtttggcctcggagtaaagactggaattgatattccgggggaatcggcaggttataaaggaccttcgagtgcggcagacattggtaaggcgttagacctctcctttgggaactacgatgcttacaccacaattcaaattgcacagtacatgtcgacgattgctaacggagggtatcgaattgctcctcacgtggtggaacaaatccgaagtagtcgttcaaatggtaagctaggggcagtacaaagcaccaccaccccgcaagtgttgaattacatcgacatgagcaaggaagaaaagaaaatggttacggacggactatataaggtagtgcacggtaccaataaatataaaaccgggggaccgcttgcaagtatttcaccaggaatctcggctaaaactggtacggcgcagaccactactaatgggaagtcaacggtaacgctatccttagcttcttttgcaccatctaacgatccgcaagtcgtcgtggcattggcattaccagggttgagtacctctagtgaagctgataacatgaacgcggctaagaagatttatgaagcttactggaaagacgtccaatcgaagtcttccttagaaaacccaactaaggcgactaaagaatcggctgcgcaaaacttaaatgggtaatttatcgaattcattatggaaaaaatatgtaaatcgtggtagcatgtataatgctagtggattttagaattcaaatatatataattaatggaggtcattccaatgcgtgtacacattactttagaatgtactgaatgccataaccgtcaatacttgtcatcaaagaacaagcgtaacaatccagatcgtttggaattaaacaagtattgcccacgtgaacgcaaggttacattacacaaagaaactaaataataattaaggctaggggccccaagttggaggttgctggtcttttttattacaagttcaccgaatcaggaggaagaggcccgtggataaaaaacaatttcggcaacgtcagatagaacagttgcgacagttgtctccggatgttaaggctaggctagaagagcaaattatggaacggttctttgaacaaactgcggtcagcacggcaaaaaacgtagcaattacgttaagtcaaaaatttgagctaaacacggcccccattatccgacgcctgcaagaacgcaagatttcagtgttggttcctaaaacttttgaaaatcgacggatggagtttgtttcgttaacctccgagacccagttggcaccccaggcctttggcattttagagcccgtggacgggattccggttgcacccacagctcttgacttgattgtggtcccggggctagcttacgagcaaacaggcggtaatcgtttaggatttggcggaggatactacgaccgttatttaaaacgggctccgcaagcacataaaattgtgttagcatttaatcagcaagtttatcctgctgctcactggccggtagatcaatttgacgtgacgatggatctaattattaccgagcaaggggttcaatttaaaaacgaacggataagatagaatggacaaaacaaaaattaatttgaaaaacttttttgccggacctttcgtgacgattactttagttgcgttgaacatgttggtttacctatggctaaccttagcaggcggatcaactgatctgccggttttggtaactcacggagccatggtgccagccatgattaaagatggtgctggatgggcaagcttgtttacttccatgtttgtgcacatcggtttcgagcacttgttatttaacatgatcacgctttattttattggacgcttactggaacaggtaattggtcacgggcgttttctattaatttatttgctttccggaatttttgccaacgtagttagtttagcgtttgctgcaccaaatagtatttcagcaggggctagcggggcgatttttgggattattggtgtctggataatgatggctgagcaataccgaaactatccttttttagccggaatgggccgtcaaatgctgatttttagtgcgttgggaatcgttagcggaatgtttggtacaaatattgatattttcgcccacctaggcgggctagtcgctggctttctactaggttacgggtttagcttccctaatttaggcaaagtacccctaaagaaaagacttggtagcggggttcttctactaattttattgggagtatttgtgaaattagcgtttacattatagcgataatttggtaaattagttgagatggtattatgaaaacactttatgatgtgcaacaacttttaaagcaatttggtgtctttgtttacgttggtaaacgcaagtgggatattgaattgatgagcattgaactgaaaaatttgtataaagcgggggtaattgaccagccgacttttgcaaaagctcaattagttttacggcacgagcaccatattgaagaagttagagatcataagcaaaaaaatggaggttttttagactaatggaacggaaattaattggggttgaccttggtggaacaacaatcaagtttgctattttaactgaggatggcgagatccaacaaaaatggagcgtagaaacgaacgtccttgatgaaggttctcacattgtcccggacattattgaatccattaatcaccacattgatctttacaagatgagcaaggatcaatttattggaatcggtatgggtactcctggaaccgttgatcgtcaacgcggaacggtaattggcgcatttaacctaaattggaaagaaacccaaaacgtcaaggaagaaattgaaaaaggcacgggcattaagtttgcaattgacaacgacgcaaacgtggctggcttgggtgaacgctggaaaggtgccggagaaaacggtgacgacgtggcgtttgttacccttggtaccggaattggtggcggtttgatcgctggtggtcaactattacatggaaaggctggcgcagctggagaaatcggccacgtaacggttgatccagaaggctacttatgtacttgtggtaagcgcggttgcttagaacaatacgctagtgctactggtgttgtacatgtagctcgtgacatggccgaagaattctctggtgattctgaattgaagcgccaaacagacgatgggcaagacatcacttctaagctagtgtttgatttggcaaaagaaggcgacgttttagcattgcgcgtagttgatcgcgtttgctacatgctcggtttggcacttggtaacttagcaaatacgctaaatcctgaaagcattgtaattggcggtggcgtttcagcagctggtgaattcttgttagatcgggttcgcgataactttgaaaaatttgcattctctaccgtgcgttcttcaacccaattgaagcttgctcgtttgggtaacgacgcgggggtaatcggcgctgcttcattagcgcgggtatttgcttaatatatagaattttggagatgaataaaacatggtagctgcagcagcaagtaattcgagtggattttggatcaataccgtaatcattatcttaatcattgcctacttactttatcaactatatatgtattggaagcggggcaagattgcaacccaattggataatgaagcttttcgagcggggatgcgcaaggctcaagtgattgacgtgcgtgaaaagaaagagtttgatgccggtcatattttaggtgcgcggaacatcccttattcccaaatgaaaagtcggacgcaagagttacgccctgatttaccagtttatttatacgatcaaggccggacgtttagtggacgggcagcaatgcttttgtcaaaacgcggctttaaacaactatatattttgaaatatggttaccaacgttgggatggaaaaactaaaaaggctaaatattaaaaagagattgggttaaaatggaattaacccaatctctttttgtatactggtgccaacttaaggttagcaatgtttttaaaacgaattaaccgttttgggccgcgtgccgtttacgctctgcgcgtcgccgattttcttcagcacggttttcgatttcttcgacaggctccacgactaccttatgaaaggtgtacactgcacctgcaatggcaccaagagttgatacggatccaaaaaggaatcccttaacaaatttacccatgtaattcagctccttatttaggttaccctaattatgcgctgaattgcccaaaaataccagaaatagatctaggagaatgttatgttgacgcaagtaatcgcccaccggggcagtaagggtgttcgacctgaaaatacactagcagcctttaaaaaagcaattgaagagggtgctgatggaatcgaaacggacgtacatttatctaaagatggtgaaatggtgatcattcatgatgagactgttgatcgcaccactaacggaacgggccgcgtatttgaccatactttagctgagttaaagcagctaagcgctggaggctcctttagcggaaggtaccaaaacgagaaaatccctacattgcaagaagtggtcgacttactaattgcggaacgatataccggaatctttaatctagaactgaagaccgacaaatttaagtatcctgggattgaacaaaaagtgtttagtttttttaaggatctcgactacccgttcgagctggtgtattcgagttttaacccggaaacattagttacaatgcatactttacagccagacgtagagatggctagtttgttcaaatttaacgcaaaggcagctcgcaagttgacgcaccgtaaagtaattcaaaattggcaccctagtatggcttgggttcgggggcatcgttttcttctaggaaaacgacgtttacgcccttggacaattaacgtggaaagtgatttaagattttgctttcaaaagggctttttaggcgtgattacggattatccgacccgtgcattacaagtccgggcaactattcaaggaggatgagatgcaaaaagttttagcaattgtgggtcctacggcagttggcaaaaccagcctgtccgtcgagttggctaaacgctggaatggtgaaattatttctggtgattcaatgcaggtataccaacgacttgatatcggcacggcaaagattacccctgaagaaatgcagggaattcctcaccatttaattaacgttcggacggttcaagaacgttttaccgccgctgattttaaaaatacggcctcgcagttaattaaagaaattaacggaagaaaccgattgccaattattgttgggggaaccgggttttatttgcaagcgttattgaacgacttacagctggggaccgctaatgaagatcgacaacaggtcgaaaaagttcgggcagcattaaatcaacaggaggacgatgcactccggcaacagttgaaaaaggtcgacccggtaagttacgcgaatattgatttaaataatcgtcgacgggtgattagggctttggaagtctaccaaacgacggggcaaaaattttctgaacagactaaatcacggggtgagttagcctatgacgccttcctgatcgggttaaatacggaacgggcgaagctgtatgaacggattaaccaacgggtggagataatgttggaacaaggtttagaagctgaagcccgctggttgttcaaacagccggaggtccctcaggcggtgaagggaattggttatcgtgaatggccggcatattttgcgggtgaacaaacttactcaactacggtggctcaaattcaaaaagattcgcgacattacgctaaacgacaattaacatggttccgaaaccagatggacgtaaattggttcgatattattcaaaacccaaatgaaaaacaaataattaatcaagaaattgaggagtggttagtgaaatgaagagttggaaagaccaatataaaccggaagtacaaaaattaattaccgaggttgaacaacaaattcagcctaaattaaatgaaattgatgatcaagtgacttacaatcagcaaaaagttttgaacgcttttcaaaaagaacgggttgctgaggagaatttaaacggggctaccggttacggttataacgatatgggtcgggacgccttagaccaggtttatgcagacgtattcaagactgaggatgccttagttcggccacaatttgtttcgggaacccacacaattagtacggccttttttggaatgctgcgacctaatgataaattattgtacttaactggaatgccttatgacaccattcaagaagtaattggaattactggtgaagctggccggggttcgttgaaagattttcaaattgattttgattacgtgccattgttagctgacggaaaagttgactttgaggaaatgcggccgaaattgactcccgatgtcaaagtagtggccattcaacgttcccgtggatatgatagccgagcaagtttcacggttaccgaaattgaagcaatggttaaacaggttcgtaaagtcgctccagacgtaaccatctttgtagataactgttatggggaattttctgaaactatcgagccaaccgaagtcggggtagacgtaatggtagggtcgctaattaaaaatgccggaggcggcatcgcgcaaactggtggatacgtagttgggcgcaggagcctcattgaaaaaattgctagccggcttactaacgttggatcgggcaaagaagaaggggcgaccttagaaaacttgcgacggatgttccaaggatttttcatggctccggcggtcactggggcagccattaaaggtgctatttttgaaagtgccattcttgaaaagtgtggcctccaagtggatccaaagtggaacgatgcgcggacagacttgattcagaccattaattttggaaagccagaaccaatgattaaatttgctaaacaaattcaaaagaattccccaattgattcttacgttgatccagaaccatccgtaatggccggctacgaagataaggtgattatggcagcgggaacctttgtacagggagctagcattgaattttctgcagatggcccgttacgagcgccatatacgttatatttacaaggtgggttaacctacgcacacgtaaaagtggcgattgcaaaggccgtggaagcaactttttttagttgatgttagaaaacctgacatgattcttgacgggcagattttcaattggtagaataagctcaatattaaaggagttattggtatgagtgaaaaagagctccgtcgttcactgtcagttttaccaattggtacagttatgaaactgacatcgctaactgcgcgacaaattcggtattacgaacaacaccaactggtatttccggaccggagcgaaggcaatcgacgattattttccttaaacgatgtggatcgtttactggaaattaaggattacctggcagacggtttaaacatcgctgaagtaaaagagcagtttgctcagcaagccgaagcgcgaaaacgttcgatttcggatagccagatgcgcaaaattttgcgcgacgaattattgcaaacgggacgcttgaccgacgatgatggcccaactttcccaattaaacgaatttaataaaaaaataagtggggcggacatacaattatggcaaagaaaaattacacaccagcagatatacgacagatggcaaaggataacaacgtacaatttttgcggttaatgttcacggatctcttcggggtgattaaaaacgtcgaagttccaattagccagttagacaaattgctggaaaataagttaatgtttgacggctcttcaattgatggctttgtacggattgaagaaagtgatatgtacttgtacccagacctttctacctggatggtctttccatggggaagtgaacacggaaaagttgctcgaatcatttgcgaagtgtatacaagagatcgtaaaccgtttgctggggatccgcgtaataacttaatccgcgccctccaagacatgaaggacgaagggtttaccgattttaacatcggacctgaaccagagttcttcctcttgaagttagacgaaaatggtaaaccaacgacgcacctcaatgaccaaggaagttactttgacttggcgccggttgacttaggagaaaactgtcggcgggatatcgtgctagaacttgaaaatatgggatttgatgtagaagcttcccatcacgaagtggcacccggccaacacgaaatcgattttaagtatgccgatgcgctaactgcggcagataacattcaaaccttcaagttagtggttaagacggtcgcacggaagtataatttacacgcaacctttatgcctaaaccactcgacgggatcaacggttcgggaatgcatttaaacatgtcgcttttcaataaagaaggcaacgccttttatgatgaaaagggtgagttgcagctttcccaaaaggcctactggttcttaggaggactgttaaaacacgctcggagttacacggcagtttgcaaccccatcgttaattcgtacaaacgtttagtacctggctatgaagctcccgtttacgtggcttggtcaggttctaaccgctccccattgattcgagttccttccagcaagggactatcaacacgctttgaagtacgtagcgttgatccgtcagctaacccatacttggcgattgctgccgtcctcgaagcgggactggacggaattcgcaaccaaattgaaccagatgattcggttgatcgaaacatctaccggatgaacgttcaagaacgtcacgaagaacacattcaagatttaccttctacattgcataacgctcttaaggaatttgaaaaggacgatgtgatgagaaaggcgctgggcgaccatattttccaaagtttcttggaagctaagaaattagaatgggcttcgtatcgtcaagaagttacccaatgggaacgggatcagtatttggaaatgttctaaaaatcaattaaaataaccgtttgattgccatacctgactaatggaacaaagtcaatgcggaatcgcaggctttaagttaatttgtaaccagctttctggcttttgtttcatcgataacgaactaagagattgcctaagaattcttaaaatcttgggcaattttttatttactgcaatttttattttggttaaggcactgttttctcgtatgaaacggttttaaaacttatttttgaagtttgtttaaatttggtgactaaacgctttatttatttgaaatttttttgtaacattaagacagaaatagagaatggagcggatatcatggcagatgaacgtaagaaccacgggcaatctagtggggagattttaatttcccaactaagggtaaaggatcaatacataaacgacttagcgcaagcgattgatcaacatgatgatttacaggtttaccaacttttagagccagtacgttatcgagaagaaattgaccagagcttcgatttgaagtatggggagcatccgtttgaacttgttcgggatcaacgtgctgaactagcgcattacctaagtgataatttaattgattacctgattcaaaagtttccatttttctactatcgtgaggtagaaaaggggcaatttatcgtcttctttggaaattggtgggaccggcgccaaattgggacgctcgattctttaaacattgaattggcactggatgaagataagttgagtcaattggaaaaagcgttacaagctgaagaagctggcgaaagtttaaacggcgaccaaattgctgaactttctgctgacaacgttaggttacaaaaattaattgatggccaggctgaattagagaagaaaaaagaagagttgatgcaacaacaaagtgacctggctgaaaagggtggcttatttgagtcagcaaaggtaaaggaagagcggcaacaattaaaagacgacttagctaaggtcgaagaagaaattcaaactgctaaccaagctccaagtaagattcgggaacaacaaaaacaaattttggcattgtccaaagaagacaccatgcttggattggagacggcggctttaaagaagagctttacgagttttaaagaattccatgaattaacgcaaaatctttaccataactaccttatggatctattagacgaagggcaggtaaagtctaatggataagcaaaaaacacaactaaccaataccaaagccactaacgaattcaaacagaacatgttaaaggttcaagacgaattaaacgaaggactcaagaagggtcaacactatgcggagttaatgcaagtgttaactaccactaccgatccagaagagttactgagtgcaacgcggcaattagctagttttgaagtggatacggcagcggtagtctttccaaaaaagtttgcagctagtgactactacctgatttttatgtcacgcttgcttgagctaaacggattgacgaaccaatttcgttccgtaatgactgaggctggtgggcatccggttatgcaccatcaatggccaggcactgaacagactttccggtttgaaaaaaatggtgagcacttagcgtatgttgaacaaactagccaccaaattatttttaggttgaacttagaaaagcagaccatgagctttgataccgaaaccattaataatttatacttcttatccggttctgaaactgattcgcagtccgcgttgaaaaaacaggttgcttcttttattaagtttggccaactccttgaaagggattataatttccaagttgacttcaacatgtttgatgctcgcaacgaaaagacttacgtttttgaaggtaccggtttggacagtagtattcttgatgaattgtttgtatctgcggcacagaatcattacattttatacaatgcggatgaatttttaggcgcattcttgcgtttgaaatctaacgtaatgctaactatttttgaaatgagtgcctccgaccatcagtgggcgatgcgcgttcaagatcaagaagagcaatactctttatttgatgttttgaaagactacgccttcttaaatgattggtatgtcaataacattggcgatttaaaattaaaaatgatactttaaggtgattaataagatggattgggcaaaaatgttacaggcctcggttaaccttgaccgtgacattcggattaagcataatttacaaaacagtttggcggatcgaatccaagaagcgtatatttcattggatgtggaattggctgaaatcgccaatgctgcggaatggtttaaagtttggaagactcaccgcggaaagcgcgacggagaattatcagttcatcaaaccgttttaaacgagtttgtggatgccattgatttctttttgttgatggctaatttaaaccagtggaaccatttgattgtgattggtgatgagcaattagcaaattatcaaagtgatcagcgtgatttggacctttctttgatgtatttaaatattaagaaaatgctgttttcaacgtattcttataatcgggggacggattttcaacatgcttggcacttattcataaaatttgggatacaaggcttaggatttactcctgaggaattggaaaaggcttattttgcgaaaaaccaaattaattatcagcgtcaagaaaacaattattgatgatttgggagcgacgtttaagacgtataggtgcttcaaagaagcaagatattttactaaagactctgtttgtggaataatggtagtgtgaggccgaagtacgtttggcgaattttgcgtttataaggaagcgatgtatgtaatgacgtatactgatatctatggttttaagcacgaaaatgccaccatcgtcagtaaaaaagatgagtttcgacgtgttttcattattgaagatgaaaagcatcgccgcttcgaatgtttgaaagagcatcctgaatctactcataagggatctgcgcactggaagttaagttctaaggacactccaccagataactattgggatgtttttgagacgagtgataagtaatgtgtagggcgagggattcttgatgaatcttcgcgcccttttaatttggatagattaggttatctggcccgaaagtttattgacacattgggattttttaaatataataaacaggtacggttcggtagctcagctggatagagcatccgccttctaagcggacggtcgtgagttcaagtctcacccgaatcatacttatattggctggaagccctgtaatataggcttttgaagaaggagcgctcaccaaacgctcaccaagcaaagaaaaagcactcaatctttcaattaaggttgagtgcttttccgttttttaactggattttgatgatgacttttatcttctagtaaagaagcaactgctaatatagtggttgcttttttttattttaaaaatcagttaagggcgcaaattactttaataaaagttaaatatccgttatcattaggtaaaagaaatcattagagggtgacggacgatgaaaaaattttttgcaattttattgtcattaattatggtgacggtcgttttgggagcttgtacacacaacaaggtttatgggactgtagtagtcacacctgaaaaatacaaacagatctcggcggataagacgatgatcgaagactcaataaagggtttagaaaaatttaattccgagaatcctgaatcagagcagaaggtaattaaaactttgaacacccttattaaaaaggggcaacggcaccttaataaacaggatcgggcgcagtttaaacaactattaggggacacgcctaccggagttaaggggattgtcaaaaatgcttatgaccaccagcgtggctttgacgatgatctaagcgagcgaatccgcaataacatgcttaaagcaattaaactcctcccgcatggggttactaaacatcaggatgaacaaaataaaatttacaaacaaatgttaaaagatacccaggctgatcggaagttataccggattggcggtaacgaataagtgctgaggtaagccatagcgaggcaaaagaaaatcggttgcttttgggttataatataaataaattagcggctacgctaaggtaaccgtactgtctgatttgggaattgtttgaaacccaagggatgataacctgcgttttaatgctattgaaggtgaaaaatcaaaagtgcttctcaagaattttaagtttttgagaggcgcttttttaatctcaaggttgaaaaaggtattaattaatcaccgagaaacatctttataagacaggtccaattagtgcgaagtataccaattaatttgctttaaacgatgtagcatctttttttaaaaccaaaatacagggcgccattatttattgttatgtttacgggaataacttaacttgttaccgcttcggtgagggatgtttgtctactatgccactttttttaaaataagcgaaaaaaaggagacggaaactggactgttagcggttcatttgttgggtttggtaagctatcatgaacatgtagatgataaaagttcgctattaatgtatggtatagaatattaagggcgatacaaatttttgaatgactaaatttgcgaactctatgaggtgcttaattatgaaaaatgatccaagaattattaaaacaatcaataaactggaaaaggcgtttgtaatgttattaaagacttacgatgttagtgacattaacgtccgtcaaattagtgacgaagccggggtcacgcggggggctttttactctcatttttcagacaaaaaagaattccttgagtttactatggaaagcctaattcaagaattgctaaaaccatccctaaaggactccgcggattatgtggaagagacgaagcacgaaaacgcccatcaggcaaatgtgctttcgttgactgaaatttttaaccacgtagctgaaaattaccaagcttacacagtagtaatgggaagcgatcgactacctagtttcaaccagacgttaaaaaaacgcttaatggaagagtttgaaaagttcgcagattattacgatgacgaaattgatttaggcgggtttcccttcgaagtattgagctccttttatgtaaacggaattgtcggaatgatcaaggtttggttggaaaaaggaatgatgtacacgccacattacatggcaaacgcagcaaaacaagtccttgatagcaaagaaagtgtcaaggcaaacaatttaaagttgactgatttttttatggtttaacgttgactaattaacgataatcaagtatagtactaatgttggtgtggtctccacgctacaaccgcacagagtgagttttaagcatggcacttactttggcgagtctgagatgaataaggaggtgcacgttgtgtacgcaattattaaaactggtggcaagcaactcaaggttgaagaaggacaatctgtatacgttgagaagctaaacgctgctgaaggcgaaaaggtaacatttgatcaagtactttttgttggtggtgaatcaacaaagattggttctccagtcgttgaaggtgcttcagttgcaggtactgttgaaaaacaaggcaagcaaaagaagattactactttcaagtacaaggctaagaagggtcaacacactaagaagggtcatcgtcaaccatatacaaaggttaagattgattcaatcaacgcttagtcagttggaagggtgaagagtgatgatacaagcatggatttatcgggaagccgaccgcattagcgggttcaagctgaccgggcacgcggatgctggtgagtacggcaaggatattgtttgtgccgcagtttctgttttagctattaataccgtgaatagtatcgaacaaatcgcctcggtaatgccactggttgattcagatgatgataacggtggatttttatcagttaatgtccccgaaagtaaggatcgggaagcggaacaaaaggcgcaagtcttattggcttcttttgaattaggattacgggatattagtaaaacctatgacaagtacttagtaatgaattaacttacattcggaggtgtatttaccatggaaatgaacttacaattcttctctcatcataaagggggaggttccacatccaatggtcgtgactcagctggtcgtcgccttggaactaagcgtgctgacggacaagctgctaaggctggtatgattttatatcgtcaacgtggaacacatatttaccctggtgtaaatgttggtcgcggaaacgatgatacattgttcgcacttgcagacggaatcgttcgtttcgaacgtaaaggtcgcgacaagcgtcaagtttctgtatatccagtagcagatgctgaataagcgataagcaattcaggtcgggacaaatcatcttgttccggccttttttaatgaatttcttgttaaatagacgagcgattgatattatgaacttataataattggaggaatcttttatgagcacaatttcaacgtcagattttcataatggattaactatcgaagttgaagataatatttggcggattgttgaatttcaacatgttaagccgggtaaaggtagtgcatttgtacggactaagttgaaaaacttaagaactggcgcggtacaagaaaagactttccgggctggtgaaaagatggaacaagctaacatcgaaactcgcaagatgcaatacttgtataacgatggggcaaactacgtattcatggataacaatacgtatgaacaagttgaaattccagaagaacgtctcgaagaagagaaaaactacttaattgaaaatatggaagtaagcatttccttctttggttccgaaactttaggggttgaactaccaaagaacattgctttgaaggttgaatcgactgagccaagtattaagggtaatactgcaagcggtggttcaaagccagcaacgatggaaacaggtttagtggtacaagtacctttctttgtaaacgaaggagataccctcaacattaacacccaagacggaacttatatttcacgggcttaattttttgggaggcatagttatggcagatacgaaatacttggaattgaaggattccagttcaaaaagcggcggaatcgcgattgcacctgacgtggttgaatccattgtggggattacggtcgatcaaattgacggtgtccatttgattagcaacaatatctcaaagggctttaacaccattttaggtcgtgacgcagttggcgctggtactaagttgattgaagatgaacgcggattggtaatcagggtcaatgtgatgcttgattttggcgtatctgtaccccaagttgccaccaagattcaggatcggattcaacaacaactactatttatgaccggtatcgttattgatgaagttaacgtagtagttagtggaatggttccggacaaaaccacgtctgatattgaccctaacgatattttttcagaaaataatggtgatcaaaagtgagtttaaatcgacatcaaatgcgggaaagcgcctttaagatgatttttgcccagagcgtaaatccggacgcggatcccgaagaattaaaaaaacaagttttggaagaatttcatgaaaccgacgttgctgatccgtttctggacaatctagttactggagttcaagaaaacgtttcgtcaattaatgaaacgattggtaaagaacttaaagctggttggacggtaaatcgtttggcaaaccctgatcgggtgattttacaaattggtacgtatgaaattaaacatactgaagtgcctaatagcgtagcaattaatgaagcacttgagttagctaagaagtatacggacgaaaaggcacgtaagtttattaacggtgttttatcgaacgttgctaaagactaggttatgtagagttacggatggaaactgacattcgtaactcttttattttacaaattattttatgaggtcatgtgttatcatttaaagtgtgtaattattcaaaactggaggcgttgtgcttgggacaaatcattgatgggaaagccttagcggctgaaatcgacttacagactaaggcagaagttatgcaattaaaggaacggggaatcgttccgcatttagcagtggtactagtgggtgatgatccagctagccacatttacgttcgtaataaaaaaagacgggcggaaaagcttggaatccaatcgacggtttgccaatttccaagtagcgtaacggaagcaacattattaaaagaaattgaccgcttaaaccacgatgcctcggttcacgcaattttggttcagatgccactgccgccacaaatcgatgaatttaaggtgacgttagcaattgatccgcgaaaagatgcagacggttttcatccggtgaatatggggcggcttttacaaaataaaactgatcatactccggtggcttgtaccccccgaggaattatgcaaatgctgcataaatacaacattaatccagaaggtaagaaagccgtggtaattggacggagcatgatcgtcggtaagccaatggctgcattgttactaaacgctaacgcaacggtaacggtagcacatagtcatactaaaaatttaagcgaactaaccaagcaagccgatattttagtcgtagctacggggattgcgcactttatcaaagctaaccaagtaaaggatggcgccgtagtaatcgacgtagggatgaaccgggatcaaaatggcaaattaactggtgatgttgattttgcggaggtatctccaaaagcttcgtttattaccccggtcccgaaaggggttggtccaatgaccattaccatgctaatgaggcaaacaattgatttgacaaagtggagtatttaatgacaaatgatcaatatttaacggtttcggcgttaactcaatatatcaaacgaaaatttgacgttgatccgtatttgcatcgggtttacgtggtcggtgaaatttctaatttccgtttgcgcgttaacggccaccaatattttagtattaaagacgaacaggctaaaattaatgtaattatgtttaagtcggcgtttgcgaaggttaaatttcaacctgaagaaggaatgcgcgttattgtgagcggtcggattagcgtctatcccggaaacggcagttatcaattgtacgtcgattcaatgcaaccggacggtgtgggcgctttatatcaagcttacgagcagttgaaggctaaactagataaggaaggcttatttaaggctcctaaacaggcaattccccgatttccgaaaaaaattgcggtagtgaccagtcgttcgggagcggtaattcgcgatattattactacggtgaagcgccgttatccgattgtacaactagtgctttttcctgtagcagtgcaaggtaacgaagctgcccctaatattgccgcccaaattaaatttattaacactttacccgattttgataccatcattttgggtcggggcggaggttcaattgaagatttgtggccctttaatgaagaagtagtggcacgggcaatttttgaaagccgaatcccgacaatttcatcggtaggacacgaaacggacacgacgattgctgatttagttgccgacgttcgcgcggcaaccccaactgcggcggcggaactggcgaccccagttttgacggatgttttgacagatttacaaaaaacggagctaagagttatcaacgctttcaaaaatatattgaaaattaagcaacaacaagcgcgtcaattagaaaattcgtatatttttcaagaacctcaacgactttatgaaggctacgtacaaaacgttgatcaattaacggagcggttgcgtaatgcacagaaacagtatttagctgaccgctctgcagaattagttaaattacagcaccgcttgttagtaaacaatccgcaaaatcaggttgacttagctacgcaaaaggtgggatatttgcgggaacaattgcttagcgtaattactaggcgatttacccaatcacaaacacaaatgcaaaaattagttgcagctttagataaccttagtcccttacggattatgagtcgaggatatacttacgttactaaagacgaacaagtggttaattccgtagaaaagttatccgttaatgacgcaattaagttgaactttagcgacggcagtgctgatgccataattaaaacaattaataacgaggaaaaataatggaaaaagaaaaaacgtttgaagaaaatttacaagaattacaagatgtagtaaataacctcgaacagggtgatatccctcttgaaaaagcattgagtgaatttcaaaaaggaattcaattgagttcacaattacaagataccctgaaaaatgctgaaaagacacttaccaaagtgatgaaagacaatggtgaagaaagtgatcttgatttagaaacagatgaaactaatgaataaagaattcaacgagtttgttcgaagaagtacaccattaatcaacgatcattttgcagaactgatggagaaggttgaaaaacaccaaccccagctggcgcggatgatggcgtattcgttcaacgctggaggcaagcgcgtccgcccgttaatattactagccgttttagaggtgctgggagagcccatcaatcctgatgtgctaacggtcgcagtcgcgttagaagccgtacacacctattcgttgattcacgacgatttaccggcgatggacaatgatgatcttcggcgaggccgtccaactagtcataaacaattcggggaagcggaagcaattttgacgggggacgccctattaacgattgcttttcaatggttagcagtgactgggtttacagctgaagtcaaagccacgatgattggtgacttggcgcaggcagcgggaccagaagggatgattgctgggcagctacaagacattgaaggcaatcaccaacgctatacaattgagcaattaaaaaaattgcacgaattaaaaacgggacaaatgttgatttttccagctaaagcagctttacatattgctaagtgcgaaaccacggtggctacggcaatattacggtttgtacaaaattttggcttagctttccaaattcatgatgatatcattgacgtaacggaaagtagtgtggaactaggcaaaacggctggtaaggatcaagcgctaaataaaaacacgtacgttaatttattaggactggattctgcaaaagaacggttatcgacggttcttaatgcatgcgaagaggcgttgatccccttagttgaacggggttacgaagtttcactgcttcgcggttttttagcgtatttaaaataatggagacaaggtaatggcaaaagaacgagtagatgttttattagttaagcaagggttatttgacacccgcgaaaaggccaaacgagcagtgatggctggtgaaattctaggagataacgaagaacggttggataaaccaggggttaaaattgacccgaacactaaattacacttaaagggaaaaccgatgccctacgtgagccggggtggtttaaaacttgctaaggccctagatgtttttgacattgacgtgagtggactggtagttttagacattggctcttctacaggcggttttaccgatgtaatgctccaaaatggtgctaaattaagttatgcccttgatgtggggactaaccagctggtttggaaattacgggaagacccccgagtagtagtgatggaaaatactaattttcgctatagtaagttagcagactttaccagcggtcaaccagaatttgcctctattgacgtttccttcatttccttaaaactaattttaccggtccttaaacagattttaaaaactggaggctcggtagttagcttgatcaagccacaattcgaagcagggcgtgaaaaggttggtaaacatggaatcgtccgggatcgtaaagtgcatgaagaagtacttaagaatgttttgaccatggctaatgcggaaggattcgacgtattggggctagattattcgccaatcaagggtggcgaaggtaatattgagttcttagcatggctatctagtacggatgctgaattaggcagcattagttcgaaggtaaatattaatgaagtaattgatcgagcatattctaatttaaattcgtaggtgagataatgcgtaaaaatcaacgacacgccctcattaaacaaatcatcaataatcatcaggttgggcgccaggaagatattgttgaaattctgcaaaagcaaggaattcaagttacccaagcaacaatttctcgtgacattaaggaattgcagctagttaaggtcgccacggtggatggccgtcttcgctatgcgttaccaaagacggatagttcacaaattgaacagcgtttctttaatttactagcgacgtctttaattacgatcaaggcacaagaccaattagtttacatcgatttaaagcccgggaacggtcccagcgttgcagcaactttgaagcaagttaactatagttttgtgtttgctgtgattgctgataatgacggagtgctggtagtttgcaaagacaatgagcgcgctatacagttaagaaaaaggatcaccaaagcgatagcctatacctaggagagattatcatgttattggaattatcaatcaaggattttgcaattatcgaaaaactagatgctagttttcggcaagggatgaccgtattaactggggaaaccggtgccggaaaatcgattatcattgatgccgtcggattgctagctgggggtcgcggatccgtagactttgtacgaactggcgcggataaggccgtcttgcaaggcgtttttgatattgctgaaattgccaatactaagacggttttagaagaattaggaattgaaccgactaacgacctcgtgattactagggaattacttaagacggggcgtagcgtttgtcgagttaacggaaccatcgttaatttgaacagtctaaaaaagattgggcaaactttaattgatattcacggacaaaatgaacaccaagaattgatggatagcgataagcatttacgcttgttagaacagtttgattacgctacggtagccgacaccaagcaacggtaccaagctgcttttaaggcgtacactaaattaaaccggcgtttaaaccaaagtctaaaaaatgaacatgaatggaatcagcgggtagatatgctgcagtttcaagttgatgaaattaaggctgcaaaccttatcgaaggtgaagatgaagagttagaaaagcggcgtgatcagttggttaattttcaaagtatttcagatgcgttagcaactagttttcaagttttggaaagtgaagaaggagtttctgcaaccgatcaaattggaaatgtaatgcaagaaatgcaaggaattgctgactatgatgaagaatacgagcagattgccgatgaggttcaaaatgcctactattctttagaagatgttactaatcgagttcgctcggcgattgactcgatggaatggaaccctgctgaactggatgaagtcgaacaacggttagaaacaatccggcagttaaaaaagaagtacggcaattcgattactgaaattctgaaatacttatcgagaattgaaaacgaattggcagaaatgactggggcgggtcaaaatctagatgatttggctgtggaagtggaaaaacgtctgcaagaaaccaagcaattaggtacgcagttaaccaatttgcgccagaaaatggctttgaaactagaacaagcagttcgggatcagttggcgggattgtacatggaaaaaacacagtttaaggtacagttcaattctaaaaaggttccggaactcgacggacttgatgacgttgaatttttaatccaacccaatcctggtgaagacttgaaaccattggcaaaaattgcgtctggtggggagctttcacggatcatgttagctttgaaaactatttttgctcgtaatgagggggttaccagcattatttttgacgaggttgacactggagtcagtggtcgagtagctcaggcaattgcggataaaattcatgaaatttcaaatcactcgcaagtattatgtatttcccaccttccacaagtagctgcccgggcagactaccagttgcacgtggctaaaaaagtggttaagggacggacgatgactaatttaaccgctcttgatgatgaggggcgagttaatgaaatcgctaaaatgttagctggggtagacctaactgaattgagtttagagcacgcacgcgagctgttgcagatggaacatgaacaagcctgagtaataagatacgtaaaaagtgagcgtgggataaaagtttggtaatttttgagcattaactaagaaactaatcatcatgcttggatttggcataatgtaataatccctccatgactgtcagatgaattatgatatttcatttgacaatcatggagggatttttgaatgtctagatttaagtacacagcattagaaaaatttagcttttataattgaatttaaactacgttggctggaacgacatgagatccttaaagcctatcaagtgctaattaagttagttaaaaatggaattgaatattttaatcaacaacaagaaatggcctcattccagatgaatactggaacgaagccgtttagtaagctacctaattttatattattttgtctgtcaacttgacagagcctagtccatgatggtcgatttttagtttttctcagtcgcgatttttaatggttttcgcgctcctactacgacaaataatggattggggggttacaagccacgttgaacttgtaaaagaaaatattatattagcgcgatgctgcgaatttctgcatcttctaatgtctgggtggtatttgaattttggtcttgaatacaaagccttcccgaacggtttaataataggtggccacgtagctcgaccacccgcgaagccgttaaattgatttgcatctgaacgggaacttggttttggatagcaaacgcaatcgtatcgttgatttgagttaaggacatcgcttggtcaacaatgttaagtccgcggtcttcaggaaccacgaataaattttcataagtactacgaattgctgcgagcgaaaagttaaataatttaagcggacttagtttacgactttccataattgcctccatcgaacgtttgtttgtgtttttattatacgaacaaacgttcagttttgcaagtagttttaaataaaggtgctcaaaagcggaattactttgtcttgacatgcggaatacagttgaaaaataagtaaaaaaagtgcaaaatagtaattacatacatatatttgagggagtttggaaatggcgaaaagaggaatgttgattgttctttcgggaccttccggtgtaggtaagggaacggttagaaaagcaatctttgatcaaggtggaaatgatttccaatattcagtgtcaatgactactagaaaacctcgtgaaggtgaagttaatggcgaggattattactttgtttctaaagctgaatttgagaaaaacatcgaagaaggtcaaatgctagagtatgccaaatatgttgacaattactacggcaccccgttaaaatatgtcaaccagactttagactctggtcgggacgtttttttagaaattgaagttaacggagctcgtcaagtccgtgaaaaaatgccggacggcgtctttttgtttttaacaccgccagatttgatggaattaaaacaacggattattaatcggggaaccgaagacattgaaacgattaataaacgaatggaaaaggctgtcgatgaaattaaaacgatgcatgattatgattatgcaatcgttaatgataaggtcgaaaatgccgttgaatcaattaaaaatattattaagggagaacatttacgcgtttcacgcgtttaccctgaataccaagaaatgttaggagagttgtaaaatgattttatatccttcagttgataaactgcttgaacgagtcgattctcgttattcattaattatgttagcaagcaagcgcgcacaccaattagatgagggcgcaccagaattgcttgaccactatagttctcataaaaacgttgggaaagctttagaagaaattgttgcgggcgacgtagttattgatcctaacgaaaaagacctataattaatcagtacttaaggttaagtagaacccgtcactggaaaatctaccaaacgatactaagtgtaaagcgaggctaggaaaaatctgaaatgattttttctagcttttttacgtgattgtcattccattattttagatgggattaggtacaggagactggtagaatataaaactaggaaggtgtttgccaatgaaaatattatttgtaattaccggcggaattgccgaatataaggtggttgaggcggttcgataccaggtgaaggctggtaacgcagtaaaagttgttatgactaagatggctgaagagttcgtcaccccattgacgtttgccacgttaaccaatgaaccggtttatgatgattttaaatcggatctgggaaagccagttgctcacgtagcattagctgactgggcggatcaagtcgtggtggctccggcaacggcaaactttatcgcaaaaatggcacttggaattgcggacgattttgcgtctacggtagtacttgcgtcttcagctaagaaaagggttctgccggcgatgaacgttaacatgtggcaaaatccagcggttcaacgtaacctgacccaactcaaggcggatggggtagaaatactagagcccgtagtgggagaactggcggaaggttactccggaaagggccgttttccatcggcggaagtggttaatcagtttataagtcaaccagttagtagtagccagcagttggcaggctataaggtggtggtcactgctggaggaacccgtgaagcaattgatccggtccgtttcattggcaaccgttcatcgggaaaaatgggtttcgcacttgcacaacaagctgcggcagctggagcgacagtgactttaatcactggaccaactaacttaagccttgacacccattctaaaattaaaagaattgatattgaagacgtagcggagttaaaagcagctttagatcaggagctcaaaaatgcggatgtgttaattatggcagctgcggtttctgattatcgagttgctaaggttagcacgcataagttgaagaaacatgattttaaaaatggcttacaacttgaactagtcgaaaacccagatattttagctacgttggaccgaccggaccggttaaaatatgtcgtgggttttgcggcggagacggatgatctactagaaaatgctacgggaaaaatgcagcgaaaaggtctgaatatggtggtggctaacgacgtgggcaaccccgagattggttttaacgttgacgataatgccgtaactattttacgtccggatcaaagagctaaggtgattgctaaacaatctaaagtaaagattgcagaagcaattttaaaaattgttagcgaagaattgaagtaaaggggattagggaatgacaaaaaagtttgatgtcatcgtcaacgtaccagctctgcaaacgaacacaccatttacttaccaagcagacgcggcaattgaaaatgacattaaaattggttcacgcgtaatcgttccctttggtcaagcgggacgaccggtccaagggtttgtgattggagaaaatcggcaaggttccccgatggaattaaaaaatattatttcacttcttgaaccagagcctttcttaaatcaggaattaattgatttatcagcatggttggcggataaaaccttttcctttagggtgacctgtttgaatgcaatgttgcctaatttggttaaaattaatacaaaacggtttgtgaaagtcaatcgtcaacgaattgatccacaaagggttgttgaagtattgggcgagcagcaggtcgtcgatttaaaggttaacgagcttgattatctgcaacagcgtcaattaaaccagtgggttaaggacggtagcgttactttagagtacgccaccgaaaattctgctagaaaaaagatgattaactggatttggccgctagtggatgccgaacaaatcactcaaattaccaagacggtgcgacctaacgcccgtcaacagttgaaactattgcagttaataccagaaataagcgttaaagaaggccttagtcaagcttccttaatcaaggattatcaaattagtcgcggaacggttgaccacgcggtagcgcaagggtggttaaagcgtgacttagtagaacagtaccgggacccgtttgcgcaaagtgatctgcaaaccgaccaagcgctcaacttgaatgatgaacaagcctctgcctttaaaaaaatttcggatgctgttcaaaaccgtcgtgctaagccaatcctattagagggagtaactggctcaggaaaaacggaagtctatttacaaagcatttcccaggtgctcaaccaaggcaggaccgcaatcttaatggttccagaaatttcactaactcctttgatggttaaccgcgtccgggcgcggtttggcgaccaagtggcggtcttgcatagcgcactttctgatggcgaaaaatttgatgaatggcgccgaattatgcgtaacgaggttaaagtagtggtgggtgcgcgttctgcggtgtttgcacccctgcataatcttggtattattattatggatgaagagcactccgaaacatataagcaaaccgatgctccacgataccatgcgcgtgacgttgccatttatcgggcgcaaaatgctaattgcccggtggttttaggtagtgcgactccagcgctggaaagtcgggcacgcgcagaacggggggtttatgactttatccagattcataaacgcgctaaccaacaggctttgccagcaataagggtaattgatatgcgacggcacctgggcgacgggtttaatgagaacttttcggctcccatggttaacgcgattcaagaacgactcctaaagcatgaacaagtagttttaatgctaaaccgacggggattttcgtcatttgtgatgtgccgtgattgtgggtttgtattgaaatgtcctaattgtgatgtttcgttaaccatgcatctggatactcactcgatgcagtgtcactactgtgggcatgaagaaccgattccgcgaaaatgtcaaaattgtggcagcgacaaaattcggttctttggtacgggaacccaaaaagttgagcaacagctacaacagatcttaccgcaagcacgggtcttacgaatggacgtggacaccactcggcgaaaaggggctcacgaacggctactagcgcgttttggtaaccatgacgcagatattcttttaggaacccaaatgattgcaaaggggttagatttccctgaggtaactcttgtaggggttttgaatgcggatacttccttagaactgccggatttaagagccagtgaacggacttttcaattgttgacacaggttgctggacgagccggacgggcgcaaaaagctggtgaagttcttatccagacctttaatccggaccattacgcgattaagttggcgcaaaaacaggactatgaagacttctttcaaaaagaaatgtatctgcgccacctagggaaataccctccgtattactttacggttttaatcaacgttgcggcttccgacgaagctactgcgcaaaaaaatgcgtacgaagtgttaaataaaattcaaccccagttaagctcgcaagcaattgttttagggcctacgcctaaatcggtttctaaaatcaagcaaaaatattattaccagattttaattaagtaccaaaaagagccgcgactccatgacgccttgttaaaggtgctaaatgaatcacaagaaaagtttcggcacggggtccgaatcacaattgatgcagatccgcaaaactttatgtaagcatagaaagtaggttttttaatgaaatcaattattttcatgggaacgccccaattttcggcgcccattttacaaagtttaattgaccatccggattacaacgtaattggggtggtcacccagcccgatcgccgagttggtagaaagcacgttcttacaccaagtccggttaaacaagtagcaactaagcacgatattaaggtttatcaaccggaaaaacttagtggcagtccggaaatggaggagttaattaatttaaacgtggaccttatcgtgacggcagcctttggtcaatttttaccgatgaaattaattaactcggttaaaattgcggcaatcaacgtgcatgcttcgttattacctaaatatcggggaggagcacccgtacattacgcaatcatgaatggggatgcagaaactggggtcaccattatttacatggttaagaaaatggacgccggggatatgcttgcccaagctaaaatgccaattaccgatcaagatgacgttggcagcatgtttgaaaaattaagtattttaggccgggatacgcttctggaaaccttacctaagttaataaacggagaaatcacgccggtagcgcaggatgaaggacaggttagcttttcacctaacattgcccctgaacaagaagcggttgatatcaatttaccagcacgcttagtagatgctaaggttcgcggattgcgacctttcccagttgcttacgtgatcatggaaggacagcggaccaagctgtggaagacggcggtcgttgatcaaagtactgatttagcacctggacaggtggttgaaaagaccaagcatgaattgcttgtggccactggtgaccatggtgtaatcagcattttagaattacaaccagctggaaaacaaaagatgtccatcacagattatttaaatggggttggcgataatttacaccccggaaagcaaattatagacaatgacggaattgaaaaataacccccgcgatttagcggttgacgctttagaaagtattgatgaaggcgcctattcaaatttagagttgaaccaggtgatccaggatgcagacttatcagaagtcgataagcatttactgaccgaattggtttatggtgttttacaacaccgcttgaccattgatttttatttagcaaatttcttgcagcgaccagaacagacgccgcggtgggtgattaacttattacgtacggccatttttcaaatggaatttttggaccggatccccacctttgccatctttaatgaaaccattgaaattgctaaacggcggggaagcgacggtgttcgtaagatggtaaccggggtgttacgttcttatcaacgtcaaggaactccaagtttagacaacattccggatttaacccagcgattagtaaccgaatatagcgttgctccgtggattgtggaccaattaatgtatgaattaggagaagataagtgccggaagatactagatagtattaatcagccagctcatttaagtgtcaggatgaaccctattcaacgttcgacggcggcaattcgccaaagcctatccgaagaatacgacgttcaagaaagtttattagcaacggacggattacgtttacaaaatggtcctggactggcgcagtccgctagttttcaagctggcgaggtgattgcacaggatgagtcggcaatgttagttggtgaaaccatgcaattagcaacgggacaaaaagtcttagatgcttgcgcagcaccagggggtaagacaacccagttggcccaaaaagtgggacctgatggacaagtaattgcttgggatatttatgaatcccgtacccggctaattcaacaaaatgcacggcggatgcatttaacgaacatcgttacggaagtccacgatgccacggctccttgcccagaattaaaggaagaatttgatcgtattttggttgacgccccgtgctcgggaatcggtttattacgccgaaagcctgaaacgcggtaccttaagagcaaaaaggatagcagcgatttacaccgcgttcagttggacattttagataacgtagcgtcgatgcttaagatgggcggaattcttacttatagcacttgcacaatgctccataaggaaaatcagatgacaatcgatgagtttttaacccagcacccagaatttgaactattaaaaacgcagacggataaaaaagttaaagcagaccgcgctgatctgagcctaaatatttacccggatgattttggatcagatggtttcttcattgcgaatatgaaaaaagtgaagtgattgatagatatgaaatatgcgtacctatcggacaaagggaaagtccgcaaaacaaaccaagactacgtgggaatttttaaaagtgattcagaatcgattttaacgattgtcgctgatggcgttggcggtaatcggggcggtgatattgcttctgagatggcggtttcccacattggttatttatttgagacctccgacatcaacactgttgaagacgccaaaaactggttaacccaccagttggcaattgaaaaccgtaagattctacaagcttctaagcactataaaaatttaaatggtatgggaactaccattgttttggcgttatttattaatgatcaagtggtcgtagcaaatctaggcgacagtcgttgttacatatataatcagcaggctggattacgtcaattatcaaccgaccattcgttagtaaatgagttgctaaaaactggccggattaccccagaggaagcccgtaaccacccgcaaaaaaacgtgattaccaaaacgcttggtatttctgagcaagccgaagcggaaatcaaggtatttaacgtggcggctggtgatattttattactttgcacggatgggttaactaacttagttcgtaatgatgtaatccaacaaatcttgggagatcaacaaagtctcgaagccaaaacgcgtaagctggtcgatttggctaaccacgccggcggttttgataacgtgacggtgttgattgtggaaacagaaatgggggcgagctgatgaccccgaatcaaacgctaaacggacgttacaagattattcgccccgttggtgaaggtggcatggctagcgtttatctagctcacgatttgattttagaccgggacgtagcggttaagttagtccgttttgatatgcaagacgatgcttcggctatgcgccgcttccaacgagaagcattgtcggctaccgagctggttcatcccaacatcgttagtgtttatgacattggtgaagagcacgggatgaattatctcgtaatggagtatgtagaaggaaaagatttaaaacgatatatcaaagatgagtttccgcttccgcttccgcaagtggtcaacttaatggggcagatcttgtgcggagtgcaagcggcccaccggcatgggattattcaccgggatttaaaaccgcaaaacgtgttgattgataaacatgggaatgctaaaattaccgattttggaattgcaattgccaaccagcaaagtagttttacccgaaccaacacggtgattggttcagtacagtacctctcgccggaacaagtccgcgggcacgtggctacgcaacagtcggacatttattcattaggaattattctttttgaaatgctaactggaaaggtcccgtttgaaggtgagacggcggtatcaattgctattaaacattaccaagatcaattaccgttagtaactgattttaatcaccaaattccgcaagcgttggaaaacgtggtgcttaaagcaactgccaagaacccgacggatcgctacaaaaacgttgccgaaatggcacttgatttaaaaacgaccctaagtccgcaacgtgcgcaagaaagcaagttcgtagaggattctttaactgagcacaccatcgttttagaccaaaaggcgattaaccgccaattggatgaaccggatagcgaacagacccgctcaattaagatgcaggtaaacgaaaagcttaaatcaattaagaaaaatcaccagcccgcagcaaaaacagaggaaatgcaccgacctaagcatcggcacccgctgcgcaggcgggcggcgtttatggcgtttgccatcttggccttcattttggggattttaattgcctttaagctaagcagcccgcaaatggttagggttcccaatttgcatggcttgacgcaaaatcaagcaacgaccaaattatctaaggaaaatcttggagtgggtaaaataactaaggtcgctgatgataaaaccggttataataaggtggttaagaccttacctgagaatggtaaagctgttcaagaaggaattaaggtcaacgtggtgattagtaagggaccaaatagctttgatgtggataactatgtaggtagtgattatccaagcactaagcggcaactagaagctaagggattcaccattaagaaaaaagaggtggttactaatcgttttgacaacaaccgcattatttcacaagatgtggttgctggtcaggtagtcgtcccgcgcttgacaacgattacgtttacgatcgctaaatagatggagaagtgcatgcatactggacaaattatacaattgttagcaggattttatgatgtgctaactgagcaacacgaagtgattcgcacccgggcacgggggaattttcgtaaccaacaaactaaaccgttggtgggagatgtggtcgatttcaaagaaaattcggaccaaactggatacatcactagcattcacccccggaaaaacgaattagtacgcccgccgttagccaacattgaccaagcggtagtggttacggcagctacccagccggatttctcagctaatttactggatcggcaactagtggcacttgccgaaaaaaagattagcgcagtgatctatttttccaaaacggatttattggataacgaggcttaccaagatttaaaacaaattgccgactattaccaaaaaattggttatcaagtagtttttcctgttcgccaaaaagacgatgccgatgtgaaggcgttgcgcaaactttttgctgagcgattaactatttttatgggacaaactggagcaggtaagtcgacgttgttaaaccgaattgatccggatttgaacatccagaccggtgaagtttctcaggcactaaatcgaggaaagcatacaacgcggaaagtttcgttaatgaacattgatgggggattagttgcggatacgccaggtttttcctcttatgcggtttttgaaatggcggatacggaacttaaagaatgctttctggagataaagcaaatcggccaaaattgtcgttttcgcgaatgcttacaccttaacgaaccaggatgcgcggtgaaagctgctgtagaaaatggggaaattttggctagtcgttacgctaattatgaacaattcatggggttgatccggtcccaaaaaccagattataaacgtaaagggtaccagaaaaaagatcggaggaagaagaaatgattaaagtagcaccatcaattttaagtgcagatccagcaaatctaatgaaggatgttgaacaggttcaaggagctgactacttacacgtcgatgtaatggacggcagttttgttcctaacttaagctttggattaaacactgttaagggcttggcacaagactgtgatattaagttggacgtccacctaatgattcaaaatccggaaaattacgtggaacaatttgcccaagcgggagctagcattatcggagtgcacgtagaaagcacccagcacattgcccgggctatccaactaatcaaacaagcgggtgcgcaagcagaagtcgttgttaatccaggcacaccgctaactgaattagaagaacttttaccagaagtggaccaagtattaatcatgtcggttaacccaggatttgggggacaaaagttcttggaaagttcgattagtaaagttaaacgtttgtcagcattacgccaagcacgtggtttagaatttgacatcgaaattgacggcggaattagtgaccaaaacgttaaacaagtgtacgacgcaggagttgatgtggcagttgctggatcatacatttttaacgcacctgattatactaaacaagtacaaaccttaaaggaccttactaaataatgaaaatatttaacctattagtcggcggcgacccggcaaatttaccagaaaattggcaagaattagatggtgaatgggttggcgtagaccgcggagcattacgtttggtaaatgaacagcttaaaggtagtttggcaattggcgattttgattcggtgagcgaagcagagtttgcaaaggtcgcagcgggatttgatagagtggttaaattaaaccccatcaaagatgatacggacaccgaagcggcgttagctaaggtattaaatattgacgatcacgcacaggttcgcattctaggcgttagcggcgggcggatcgaccacttgctagcaaacgtgttaatggtgctagaagcgcgctttcggcgatttgctgaacagattacgttgattgaccggcaaaatcggattacctttttcaattctggaaaacacacaattaaaaaggaagctggttttaaatatttgtcattcattccgttaacgcccattgacgcattgactttggattatgaaaagtaccaactgcataatcacatggtgcccaatgcgcgggcctacgtaagcaacgagtttattggtagtacggctaccgtttacttaagcaacggattaattgcggttattcaaagcaaggactaagtaaaataaaaaaatgctcttaacagctagatgattatctaacggttaagagcattttttgttttaagcttttaagtgcttggttatacacgagttactttacctgattttagagctcgagcagaaacccaaacgcgtttaggcttaccatcaactaagatgcgaaccttttgtaaatttggcttccagcttcggcggctgtggttcaaagcgtgtgagcgagtatttccaaaacttgtgcgcttaccggtgacaaaatcttttgccatgttgaaaccctcctttgtcacttctatatctcaatagaatctatttcaattaccataacaatttatcacattgcccggtatattgcaataggaaactttcaagtaattatccttgacagatattttaacgtgacgaaataaaagttgctgtcacttctgtttaagaattggcacgaacataatttcccagtataataggaattgacgtcgatttatggggcaggttcttgtatttagcgtctagataagatatggtaaaatatcgttggtatatatgatactaaggaggcaggaagatggctgtcaaaattaaaacaaaaaatggaaccatcgaggtttcaaacgatgtgatcgcgacggtggtcggcagcgcagctacggataactatggtgtagtgggcatggccagcaagaatcaaatccgcgacaacattaatgaaattttaaaacgtgaaaattatgcacgaggcgtggtaattaaacaagaagataatggggttgcaattgacgtatacatcattgtcggttatggtacaaaaatttctgaaatttcaaaaaatgtacaatcaaaagtaaaatataacctggaatcaatgctaggcatttctgctaactcagtgaatgtcttcgttcagggtgtaaaggcactcagcgattagttcgttgggttgggaggataaagaattggaagcaatcgaaaccttagttactaatgaagtttttgatcagatggtgcaggctagtgctgatcgcttaaaaatgaatgcggattttattaactcattaaacgtttttccggtaccggatggagacaccggaactaacatgagtttatcgttagaaagtggtgcaaagtacgaagctaacgatgctagtgaagaagttggtcacttggcaggttccttagctaaaggacttttaatgggcgcgcgaggtaattcgggcgttattttatcgcaaattttccgcggctttgctaaaagtgtggaaggtaaggaaagcttagatgccaaggatcttgcagatgcggtcgctaatggcgctaagacggcttataaagcggtaatgaaacctactgaaggaactatcttaacggtggttcgagaagccgctaaggccggtaacgaagctgctttaacgagtgataatttggctgaggtaatgcaggcaatcgatactgcagcgcaagcagctttgaaaaagactacggaactgctcccggttttaaaggaggtcggagtagttgattctggtggtcaaggattggtttttgtttttgacgcctttaatgatgttttaaacggtaaggacgtcagcgaatatcaacatgaaccagacgttaccgaaatcaatgaaatggtggaagccaagcaccaccaaagcgtgcaaggaaaaattaatcccgaagatattaagtatggttactgtacccagatgatggtgcggatcggtaagggactccaagtttctcaagaatttgattacgacaccttctacaactaccttgcgaagttaggggattccttactcgtaattaatgacgatgaagtggttaaagtacacgtgcataccgaacatcctggcgacgttttaagctggggacaacaattcggggatttaaccaagatcaagatcgataacatgcgctggcaacaagaagagattattgaacaagacgactcgttgactgctcccgaacctaaggaagcccccgaaacggcggtaatcgcgatttcttcgggagacgggatttcaaaattgtttaatagcttaggcgttacccacattattagcggtgggcaaaccatgaacccaagtacggcagatattgctgcaatgatcaacaattcgggtgctaagcaagccattgttttacctaacaacaaaaacatcttcttagcagcagaacaagctgtggaagttgctgaaattccgactaagatcgttcacagtcggacaatttcccaaggaatggcggcaatgcttgagttcgatcccgaagcggaacttgatgaaaatgcaagtgcaatggaagataacctagataccgtcaaaagcggtcaagtaacggttgcggtccgcgatactaagttagacggacgtcaaatccgcaaagatgattacatgggcatgattgatggcaaaattgttaataccgctgcaaacctcatggaagcaactactgaaatggttaagttaatgcttgatgaagatagtgagattgtaacgattatttatggcaaagatgcaaaccaaaaacaagcagatgaattagaacaggctatcttagcaattgacgaagaccttgaaattgaaattcacgaaggggaccaacccgtatatccatttttaatttcggttgagtaggctaagcggtttaaaagtgttaagctaatgctgaaatagattttagaggctatgacaaacgtaattgatgtcacagcctcgatttgcattgtggaggaaaaatgaaaagtctgacagattcagtgcaggtactggcaggagtcggccctaagcgcgcgcaagcactgcaagagctggggatccagacgattgaagacttgatcacctactatccctttcgttacgaagatttagcagcaaaaaagccgcaagaagttgctgatcaacagaaagttacttttcaaggaatcgtggctactgcaccgaccattgctcgctttggaaggcataaggtgcgggttaattttcggctattagtagaaaacagctcggtgatggtcactttttttaaccaaccgtggatcaaaaagcagcttgaagctaaccaagaagtggctatctatggaaaatgggatgctaaccggcaaagtttgaccggaatcaagataattactgaagaacagggaatggaagctgtctatcccactaacaaacatattcgacaagcgacaatccaacaattagtggaggcagctttgaatgaatatgctgagcaagtccaggatgtgattccggaagctttaattgaaaaataccggttaatgcatcgtttggcaatgattaaagctttgcattttcctggcgacgagcagattactaaacaagcccgccgaaccgcaatgtttgaagaatttttagtttttcaaatgggattgcaagtggttaaatcgcgggaccgcgtggaaaaaggaactaaaattgactatcagatccaactagttcgggaatttatccaacagttgccgtttgaactaactggagctcaaaagcgggttaccaatgaaattttagctaaccttaaatcagcttggcatatgaaccggttgttgcaaggggatgtaggtagcgggaaaacggtggtggcggcaattgccatgtacgccaccatcacctccggccaccaggcggccttgatggcgccaaccgaaatccttgctgagcaacacgctaataacctcattaagttttttgccaattttgacgttaaaattggtctgttagttggcggaatgcgtaagaaagtgcgcaatgagcttttggaagctgttaaagctggagaaattgacatcgtaattggtacccacgctttaattcaagacgatgtggaattcaaaaacttaggcttagccatcattgatgaacaacaccgctttggggtgaaccagcggcaaaagctgcgccaaaaaggagcgaatcctgatatcttggcgatgacggctaccccaattccccgtaccttagccattacagcttacggggatatggatgtatcgattattgatcaacttcctgctggtcgaaagccagtggttactaagtggttgaaaaaaggcgagtgggataaagtactggcattgatggaacacgaatttaaaaagggacggcaagcttttgtggtggcaccgctaattgaggaatcagaagtcatggatttgcaaaatgccatggcattgtatgaggaactaaaagatttcttcggacaaagatatgcgattggaatcttgcatggtaaaatggatggtgcagaaaaggaccagatcatggccgattttaaagctggaaagtatgcggggttagtctcgaccacggtaattgaagtgggcgtagacgtacctaacgccaccttaatggtgattcaagatgcggaccggtttgggttagcccagctccaccaattgcgcggacggatcggtcggggacagcaacaagcatattgtttactggttgccgatcccaaaaatgccgtgggtaaacaacggatgcaaatcatggttgaaaccaataacggtttccgaattgccgaagcggaccttaaaatgcgtgggcaaggggatttgtttggtcaacaacaatcgggagtgcctgaatttaaagtcggggacccggtgttggatttaggtgccttacaaactgcccaacttgaagctgctaagattgttaaccaacccgattggcaatcccaaccagctttccaaaacttagccaagtatttgaaccaagttatgcaaattgagcaagggttagattaattaaactagataataaacataaggagagtaaaaatgaaaattgccgttgatgcaatgggcggcgacaacgcccccgagcagattgttaaaggagtggctgccgctcgtgaagctttaccggacgtggaatttattttatacgggaaaaaagacgaaattactaagtatatggacaactttcggaacgtccaaattgtgcatactgacgaagtaatcactatggaagatgaaccagtgcgggcagttcggcgtaagaaacagtcttcaatggttttagctgctcaagcagttaaggaaggcaatgcggatgcaattttttctgctggaaataccggagcgctgttagcggcgggattgttcgtcattggccggattaaaggggtcgaccgtcccggaatgaccaccacgttaccaagcttacaagggcctcacgataatttcaccatgcttgacgtgggtgccaatgcggaaagcaaagccaagaatctgcacgactttgctattttaggtagtttttatagtgctaacgtaatgcatattacgaatccccggattgctctcttaaacaacggtacggaatatgataaaggggatcgggttcataaggaagcttatcaattgttaaatgacgatagctctttgaattttgtcggcaatgttgagtcccgggaattgttaaacggtgcagctgacgttgtggtaaccgatggatttaccggaaacgcggttttaaaaaatactgaaggaacggcgctatccatgcttaaactggttaaggacaccattttaaacagtggcgtaaaaggtaaaatgggcggtttactgctgaagtccgcctttagtcaaattaaagaccaaatggactattctaagcacgggggtgccgtactcttaggagttaaagccccggtagtgaaggcgcacggctctagtaatgctaaccaagtaaaaaatgctttaattcaagttcacgaaattgtggactccaaattagttaaaaatcttgccgaatactttgacatgcacgttaaatgtattcaacaagacgaagtggacaagcctcggaaaaacaattaaaatattatcaggatttataacaaatttaaggagcaagtaaattgtcaaaagaagaaatttttaacaaaattgcggcaattttggcagaccgttttgagttggatgccgatcaaattaccgaaaagcttaacttcaaggaagatttgaacgctgattcaatcgatatcgttgaatttgtactagaattagaagatactttcggagctgaaatcagcgatgaagacgctgaaaagttgactacagttgccgatgctgttaactacattagtgaacatcagtcttaatacaataatgggaaactcggtgattgaatgtattttggtcaccgagttattcttatctataaaagaattattgagtttaaatttagaaaggaatgatcgagttgttaaaagatttagaagacgatctaagtgaaatgtttgatattcattttaccaagcacgaactactggacgaagccttcactcaagcatcttacgttaatgaacacccgcaccaagggttgaagttctatgaacggattgaatttttaggggatgcggttttacagttagtagtttcggaatatctatacaaacgttatcctgaaatgccacaaggaaagctaacccgtttgcgagctgcaatggtttgtgaggccagcttcagtgattttgccaaggaatgtcattttgaccggtacatccggcttggtaaaggagaggaaaaatccggcgcgcggcagcgtccatcacttctttgtgatatttttgaatcgtttatcggagctttatatttagaccaaggacgccaagcggttgaaaaattcgtccgccaagtgatttttcctaagcttgatgaaggccggtttgaccacattattgaccataaatctgaattgcaagaacttttgcaacaaaacggtgaagtggagattaattacgaattaatatctgaaactgggccggataatgacttggttttcaccgttcaggtaagtgcggctaaccaagttttagcgaaaggtagcggacattctaaaaaagcggcggaacaaaatgccgctaacaaagctttacaaaaattgcgtaataggaattaggtatttttaatgaaactacggacaattgaaattagcggatttaaatcttttgctgaccataccaagattgattttaaggatgggatcacggggatcgttggtccgaatggttcgggtaaaagtaatattattgaggccattcgctgggtgatgggggaaacttccgctaagagtcttcgaggtggaaaaatgcccgacgtaattttttccggaacccagaaacgtaagccgctttcccgggcagcggtcagcattgtttttgataattcggatcatttcttagattccaaatttgacgaagtaatgattagccgacgcctttttcgaaatggtgaaagccagtacgaattgaaccatcaggagtgtcgtttaaaagatatcttaaatttgtttatcgacactgggttaggtcgcgaatccctgtcggtaatctcgcaaggaaaaatcgaagaaatttttaatagtaaaccggaggaccgtcgcacgattattgaagaggctgcgggagtgttggagtataagcaagataaacggcgggctgaaagtgaattagaaaagaccagtggctatttagagcgagttaatgatttaattgtggaacttcaaaaacaggtggaacctcttgaagaacaagccgcggtagcaaaggactatgtgcaacaaaaaaagcggtttgaccgcttagaacaaacccggttagtgcgaacaattactcataatagcgacctccaaaagcggtgggcaaaggaagctgaagttaagcaaactgaggcgcatcaattagaaaataaattaaacgagttggttaagcagcgtgaccggcttaaggaacaagtgaaccagcaaagtaagcaaaaagacgacctccaagcggagttagtccgcttaaaccggcttgaacaacaattagctggggagcatgacttacagattgaacgtcggaaatattttgagcaagaacaaacccgcttaacggaacaaatcgaacaagtacaagggcaaattgatgcgggacagcaggacttaaaggacttagaacaattaaccaccgaccttaatcaacaaattaaaaagactaagcaagctttacaactattaactgatgatcatcaagaacaaaagaaggctgatttgcaagcccaaattgaagacctccgggcgcagtatgttgaccatctccaaaaattaacctcattgaagaatcaatatagtttcagccagcaagatcaaaagcgtgatgaacaacaacggttgaaagtggagttaaatttagcacggtttaacaaagagcttcaagagcttcagactaaactagctaaattaaaccaggcggtggctaacactacggaaatttttcaaaaacaaactggtaaacttcaagaactgacgcaaaggcgcaaccgactaagccaagaatacgaggaagcgcgtcagcagtggctagacgggtcggacatcgtgcaccgcgcaaccagcaaattagaagctctgaccagtttgaaaaatgaacacacgggcttttatcaaggagtacgtgcggttttacaacaaagggaacggtttccagggttggttggtccagttgcggacgtgattgaagtaccggaacagtacaccgtggcaattgaaaccgcgttaggaagccaaattcaaaacgtagtggtggacacggaccaaactgccaagtcgattatcgaatttttaaagaaacaacgccaaggcagggtaacgttcttacctcgaaatacgttgcaggcgcgaacgattcgtagcgaaatgcttacgcaagttcactcgctaactggtttttgcggggtggcaagtgatttaatcaaggttgctaacgttgaccgcgtagttagccagcatttgctagggacaacgttaattgcggataatttagaccatgccttacaaatttcacaacgagttcagcgtcgttaccgggtgattactttggccggtgacgtagtgggcgttgggggaacgatgactggtggaaccatgaaacatggtcgccaaggacttttgcaacaggaccaagaaatcaagcggctgcaaacgcaaattgccgaaatgaagcaaaagttagcgataaaggaaaggcatgtgcaagagttattagcgcagggtaaacaagttcaaggtgaaatggcaaaattaactgaaacgcagcgaaccagcgaacagtctaaggttaagtcagaaaatcaagttagcttaactaaagagcggattgacgaactcgaacgtcggattaaagctactaactttgaattaacccagttgagcccagtagatgacgcaattcaaaaattacccgcccaaatcagcgaattagaagcaaaaattcaagatttaaaggaccaaacggccgaaaagcaaaagcaattggcactttttgataacgatgctgaagctcgtcaggaacaacgggctgaattacaaataaaattagcaaaactaaacgagcagtactctcaaaaagaacaacaatttcagacggcaaggcaaacccaaattgacttgcaggatcgtttggaagaaattcggcgtcagttagttcagctacaagaggaacaatcttcgtctgcgaaatcccaaacgcaagcggtcaacctagtagatgttcaaaaacgtttgaaacaacgtgaagaagcgatgacgaacttgcaaacagaatggcaaaatgctcaggtagcacaagaccgggtcattgccgactacgaattaacccaaaagcaatgtagtgaagcgcaaagtcaggtccaagaagcgcaaaatacgttggcgttagtggaaagtaaaatcgaattagctgctgatcagcttaacgatgattaccaacaaacgtttgaaagtgctcaagcagttgttgaccaatcgttggacgatgagcagttacggcgtgaattgaaattattgcgccggggcttagatgaactcggcacggttaacctcggagcgattgctgaatacgagcgtgtttccactcgttataattttttgaaggaccaaaaggaagacttatctagttccaaacaacagctggaacaatccattgcggaaatcgaccaagaagcaagtcaaagatttaagcaaactttcgaccaagttgctgaagaatttggacaagtgtttgttaaaatgtttggtggagggcatgccgaactcgaattaactgatcctgataatctactgactaccgggatcgaaataaaggcccagccaccggggaagaagctgcaacgtttgagtttgttgtccggcggagaaaagtccttaacggcaattaccctattgtttgcaattctacaggttaaacccgtcccattttgcattttggatgaggttgaagcagccttcgatgacgcaaacgtggaccggttcgcgaagtatttgcgaactttccaagacacgacccaattcatcgtgattacccaccgaaaagggaccatgatggaggcggacgtactttatggagttaccatgcaagaatcaggtgtatcaaaaatggtttcggtatcagttgatgaaatcgaacgaagagagcaggtgggataaatggcatggttttttggtaaaaagaaaaagaaggctaaagaagccgaaaaaaaggttgaaccatcaaccccagtttcacaacccgaagtagaggcttctccggataaagtaaaagaagcaccaacgaacactacaccggtaaaggaaccggaaagtaaaccagaaccagctccgactaaggaagttagttctgcggcaccagttaatgaagagccccaattaaatgaagctgaaaagtatgatcggggattggaacgttctcgaaagtcttttggtcaaaagctttccgctttgtttactaatttttcaggggtagatgatgatttttatgacgatcttgaagaaaccctaatcgaagccgacgtcggctttgacacggcgcttgagattagtgaagaggttcgtgaagaaattgagttcgaaaacgtttcggaccccgaaaaaatttcgcaactaatcgttcggcgtttggtagatttatatacgcgtaacggcagtgcagaagataaccatttagtcttcagtaaggaaggcccaacggtatttctttttgtaggcgtcaatggtgttggaaagactaccagcattggtaagatggcggctcgcttcaaagctcggggacggaaggtccttttggcagcctgcgatacgttccgggcgggggcaattcaacaattggaagagtgggctaaccgggacggtgtcgatatcgttaccggtaaggaaaaatctgaccctgcagcggtagcctttgaagcggtaaaaaaggccaaagctgagaattatgacttggttttcattgatacagctggtcgtttacaaaataaagttaacttgatgaaggaattagacaagattaagcgggtaattagccgtgaaatcccggacgctccgcaagaatcactactagttctggactctacaaccgggcagaatgcgttaacccaagctaaagcatttttggaaaccactaacgtaacggggattatcctcactaaactagacgggactgccaagggtggaatcgttttggctatccgtaaccagcttcacctggcagttaaatacgttggcttaggggaaaaggttgaagatcttagtccgtttaatccggaagagtacgtccggggattgtttaaaggtttactggatgaatagtgcctatggaaattgaaaagaataatcgggtcaatagcttgttggaattttatgaacagttgttgaccccgaagcaaaaagagtacatcaccctgtattatgctgatgactattctttaggcgaaatttctgaggaatttcacgttagtcgtcaagcagtgtatgataatattaaacggaccgtgaaaattctggaaaaatatgagcaacagttgcaccttttgcgtaattttgaggcccgaaacgccaaatttgaccgtattcaggcgtacgttgccaagaaatatccagaagatacccagctcaagcgttttttagcggaccttgagcaaagtgaagaagaataagacggaggggctgtcaatggcttttgaaggtctaacagaacgtttacagaaaacttttaataatttaagaaaaaaaggaaaggtaacggaagccgatttgcgggataccatgcgagaaattcgcctcgccctgttggaagccgacgttaactttaccgttgtaaagaaatttgttaaaaccgtccgagaacaagcactcggttcggatattttagaaggattaaatccggcacaacaaatcgttaagctagttaatgatgaattagtgaagatgatgggtaccgaagctagtcctttaaatcaggcacctaagattcctaccgtaatcatgatggcagggttgcaaggtgctggtaaaactacgacgattggtaaattagcattaaagctaaaaaatgaaaagaaagctcgcccgctgttaattgcggctgacgtttatcggccagcggcgattgaccaattggttcaagtcggtgaacaaattgacgttccagtttatcaagagggtaccgacgtcagcccggttgaaattgttcggcatggtcttgaacaagcagctgaaaacaagaatgattatgtttttatcgatacggcagggcgtttacaaattgatgaaaagctaatgcaagaattagccgacatcaaggatctagcacatccggatgaaattctattggttgtcgatgcaatgaccgggcaaaacgcggtaaacactgcggaaggctttaacgacaagttggacgtcaccggagtaatcctgactaagttagatggggacactcgtggtggtgctgccctgtcgattcgagcagtaactggtaagccaatcaagtttgttggtcaaggtgaaaagatggaagacttagacgtcttccatccagaccggatggcttcccgaatcttgggcatgggagatatgcttactttaatcgaaaagactcaaaaggaattcgacgaaaagcaagcggctgaaatgtcccaaaaaattcgggaaaacacctttgatttcaacgatttcttagatcaaatgaatcaggtccaaagtatggggccgattgaagacatcgtcaagatgattccaggaatggcgaataatcctgcgttaaagaacattaacgtggatccgaaggacattgagcatactaaggcaatcgtctactcaatgactaaacaagagcgcgaaaatccggacattttaaatccgagtcggcggcggcggattgctgccggatcgggtcggccagttgtcgaagttaaccggatgatcaagcagtttaaccaaatgaagaaaatgatgaaccaaatgtctaagggaaactttggcccaatggaagggatgtttggtaacggaattaagggaaaattgtctaaaatggcaatgaattcgatggttaagcgaaacaaaaagaataaaaagaagcggatgaaaaagaataaaaagcggaaataatcgtattttagctgattaaataattaaatttaatctgttaaggaaaaaacctttacatctcttcgaataactggtatattattactcgtgaataaatagtggaggtgttaacatgtctgtaaagattcgtttaaaacgtatgggttcgaagaagcgtcctttctaccgtatcgtggttgctgattcacgttcaccacgtgatggtcgttttatcgcccaagttggaacatacaacccattagttgaaccagttgctgttaagcttgaagaagaagaaatcatgaactggttaaacaatggtgcacaaccttcggatacggttaagaatattctttctaaagcaggaattatgaagaagtatcacgaagctaaatatacaaaataggttttaacctgaaatgaagggcgtaagtaaaacggttgttttattacgcccttctttttgtatcggaggaagaataatgaattattataacgtggccaaaatcgtcaacacgcgtggcttacgcggtgaactaaaggtgattgcgtacaccgacttcccggaagaacgtttccaagccggcaccgagttgcaattgtttaaagacgcaaacgcaacgacaccaacccaagcggtgacggtgcaatcggcaaaaccttttaagggaatgtggttaatccaattggccggactagactcaatcaacgaagtcgaaaagttcaagggcatgatgctaaaaattgctgaagaccagcttcaagaactcgcagatggtgaattttaccaacatgaaattattggtttgacggtaattgaagatggacaaaccctcggtaaagtgaaagagattttatcgtatggccctaacgatgtttgggtagttgaacggccgggtaaaaaagacttgttactgccatatttgaacgacgtggttttaaaggttgacttagataaaagtatcgttgaggtcgcggtacctgaggggttagattaatgaagatcgatattttaactttatttccgaaaatggttgaagtgccactccacgagtcaatcgtgggaaaagcgatcgaaagcggcaaattaggcgttgaggtgactgactttcgggagtattcaactaataagcacaagaacgttgatgactacccatacgggggcggcgccgggatgttgttaaccccgcaaccaatttttgacgctatggaacatgttaaaagccaaaaccagcaatcggcaggtcgggtcattttggtagatccgggtggcaaacgattcgaccaagcgatggcagaagactttgcgaaagaagaacatctgacctttatttgtggccattatgaaggttatgatgagcggattaagacgttggttgacgacgaagtttctttgggtgattttgtgattaccggtggtgagctagcggcgttgacgatgattgatgcgacggtgcgcttacttccagatgttttaggtaatgacgaatctgctgaagatgattcgttttcaaccggattactggagtttccgcagtatacccgtcccgctgattttcgaggattaaaagttcccgagattttattaagtggtaatcatggcaaaattgacgagtggcgccgaaccatggcattaaagaagacgctcgaacgtcgcccagatttgctaaaaactgctaaactaacgacggaagaccaaaaaatcctccgggaattgcaaacgccagatatataatgaggatgaacattattttagcaattatctagtaaaaggatgacatggcgcaaagctggccaccctaaaatattttaaaagataactatgttgctagaatagcggttcatcctttttttactagtaacttacgtttttttaaattataatgaatctaaataagttaggggagtgacttttatgaccaaaatcttttccgttcgtaatcttaattacgtggttaacggaaccagaattttaaattcaattgattttgatgcggaacttggtgattacgttacgataattggcccatcggggtcggggaaaagtacttttttaaagattttggccacgttgctgaccccgacaagcggaacgattatgtatcatggggaagaccagcttgcgatccccaaaattgaataccgtaaggaagtttcttattgttttcagcaacccacgttgtttggggaaacggtgcgtgataatttagcgtttccttttgaaattcgtaaccatccttttaatgctgataaggcagttaggtcgctcgaacaggtcgatttaacggcgcgctttttggacaaaccaattgttgatctctcaggaggcgaaaaacaacgggtagcgttggtacgcaacttactcttcccaccaaaggttcttttgctagatgaagttaccacggggttagatgtggataccaaggcgattgtccatcaattaattgaaaaaatgaatcaaaaaagtaaaattacggttttggcaattacgcacgatgaagccgaaattggtttagctcatcggttagtaacaattgaaaatggcagaattgtaggtgaacgacatgaacttaatcgttagtcccttagcattatccttcgccatcatcctggtgattattgccttaggaatcaatttacacgaaaaaattggtttggaaaaagacatggtggtgggcgtagtacgagcggttattcaattaaccgtcgtgggttacgttttaacgtacgttattaaggttgatcgggtgtggttaaccattttaatggtgttaatcatcatctttaatgccgctcttaacgcaaaaaaacgggcggacaagattccccacgcgttttttatcagtctcttagcgattagcgtggccaccgtaactaccatttgcttgctagtgttggctcgcgcaattaaatttacccctagtcaaatcgtaccgatttccggaatgattgctagtaacacgatggtggcgattggtttatgttaccgtagcatgaatcaaaccttcaaagaccagcgtcaaggggttttagaacgattggcgttaggagctaatttaaaacaggcgtcacgggcgattgttcaaagttcaattaagacgggaatgtcgccgaccattgactcggctaagacggttggaattgtaagtttacctggaatgatgtcgggattgatttttgccggagtggatccgacaaaggcaattttgtaccaaatcatggtaactttcatgttgctagcggctactagtattggtagcgtgattgcgtgttatatggcgtatccgcttttttataatgatgatttacagctaaaataactttgcatcacaacagcggatgtgttattattttatttggcttgaatgccaacaaataacaatgttccgctggctccgggtgagttaagaagattggtgaagggaagattttttgatgaatgaattaatcaacaagattacaaaagaacaacttcgcgatgacattcctgaattccgcgctggtgatactgttcgggttcacgctaaggttgttgaaggtaaccgcgaacggatccagatgtttgaaggggtagttatcaagcgtcatggttcaggtattagtgctacatacactgttcgtaagatcagtaacggaattggtgtggaacggacattcccactccactcaccacgtgtagctaagattgacgttgttcgttacggtcgcgttcgtcgtgctaagctttactacttacgtgcactacatggtaaggcagctcggattaaggaagaccgtcgtaaagctaacgctatgaaaaacaaatagtctttaaccctactaagattgggtaacggctattgaagaaaacaattcgcttaattgcgggttgttttttttgttgttaagaatgtaaagaaaacgctaacggaggtagttgaatttatcaccaccaacaatagaattataaccgcaaatttaggttgacgttctagaatgagtcttgcaaaatagtaatttttatagtggatagaattttatacctgaaagaaggaatacataatgcaagatttaacatttaatacgcttgacagttgggccctttgggatattccggctagtgatatagatcaacttgatgatgaggagcgacaaacacgatttggtgaagtttatcaaccaaaccattttccaaaagagcaattaacatcggatttagagcaagctttatcaaaagttaaatttgtactagttggcttaaaccctggtaatgcagggataacgattgataaaaaacaggattttttaaatttccatggtcaaaaaaagagcctcgactatcgtttagcagcagctatttatggtactccactttggggagcctttatgactgatttagtagccattaatgaaagtaagagtgataacgtggtcagtggggaagctgaggtcaaggcactggaatcacatcttgatcaacttggcgtttcatctcaggccgtcttggttggacttggagataaaactgccacaaccttacgtcaatttgcgcaacgcccggttgaaaagctaccccattattcaggcgcaaacggacactggaaagctgctaatacacgacaagcagttctaaagattgctgaaaaatattaataactcaactaggtaattaatcaaaaaggaatccggagtattcgaggagcatttcgtatacttaggatttctttttgatttgataacaaagactataaattagttattaattcattattagtgactgattaagttgagggaacatcatgagctttaagtaaattaaccgagcggtttaccattattagaattaacgatcttcaagagaatacgtatattaaaatttcaagcaaaaataaaaaggaaagacataccttttaacgagatatgactttccttttttattaaaaccttttactacgcttggataaacttaacggcagtcccgtaagcagcaaccgactgcatatccgaaccaattgatccagagtcaaaacgcatcatgactacggcgtcggcgcccatttctgcagcattttcgcgtaaacgttggaccgcgatgtggcgggattcgtctaacatcttggtatagtccttaatttcgccaccaacgatatttttcagtcctgcgccaatattgcgcaccaagttctttgattgggtggttaagccaaaaacttctccaagcacctgatattccttgccaggaatgtgttcggtagtggtaactaacatttcttccataaaaattcctcctcgtataagttacggacgtaaatatgcataaccagcggattgcttttctactagttcaacaactcccgagggaaccacttttgctgctgaaattaaactcccgggattaatttgtcgttggtctaatgaattttggcaaacggctaactgattttgtggttgtagggcggattgaactgacgcactacgagcctgtgaagtttgtaaagccaccactgccggaccgttaacaagtaattcgatcacgtcgtctgaattaacgtaatgctcattcaaatgtgcgagattgcttaacaccatcggccatttttcaatttcgtcaatatggataattattttcattagtaacgagtctgcctttctcaatggttatgtaactcatattataacgcgaatcaaagacagtagggagctaaaagcaagttacacaatcagtttatttgtacaccattaacgatgtctaggatgtataaaaaagacttgacacgttaaaagccggtctaaaggcaattttagtacatggggttaattaattgtgacgattcacatcaaactgtttcagtaagaaaggaaagcctccagccccgtggttgcggagtttaacggagctttattaaaaaatagaaaaaagttcatattttaaaatcaattgcgcaaagatatttttctcgctattcttttgaatattccttatgtaaggaatcgcaaggaacactcggttgaggaggaaataagaatttgagtattttaaacgcggcagaaatcatggaattaattccaaaccgttatccaatcttgtttatggattacgttgacgaattagaaccaggaaaatcaatcattgcaactaaaaacgttactattaacgaagaatttttccaaggacatttcccgggaaatccggtaatgcctggcgtattaattattgaatcattagcacaagcagcttcaattttaattttgaagtcggaagagtttgccgggaagacagcataccttggcgcgattaataatgctaaattccgccagattgttcgtcccggggacgttttgaaattacacgtcgaaatgattaagaaaaaacgcaacatgggggttgtggaaacatttgcaaccgtcggtgaaaagaaagtttgccaagctcaattgacctttattgttggggcaactgaccagcctaaagcatagttggtgaagtaaatgggattaaaaattattgattcggcaaagtatagtcctgaaaggattattactaacgacgaactagcccaaacgttagatacgtcggacgaatggatttcgaaacgaaccggcatcaagcggcgacaccgaattggtgaagaaactaatgctgcgatggcaactagggtcgcagaagctttattaaccaagacgaataccgctcccgaagaggtggacctgatcgtggtggcgaccatgtctccggattaccaaactccttcggtggccgcactagttcaaggtgcacttaaagcttctagagccatggccttcgacattagtgccgcgtgcagcggctttgtttacggaatgagcgtggtgaaccaaatgctccagtcgccgaattatcataaagctttattaattggctcagaggcactgtctcgcttgttagattggcaagaccggagtacggcagttttgtttggtgattccgcggcgggcgttttagttgaaaatgatcccgcgagttctgctagtttaattgccgaacgactaactacttatggcgatttaggggaacacctcacagctggtaacgtggctgcgttaactgattcaacgcaatcttatttttttcaaatgaatggccgcaaggtttacgaatttgcaactaaccgggttcctgaatcaattcaagcagtattacaagcggcggaaatcgacgcgaaagacgttaagtatttcctgttacaccaagcgaacgcccgcattattaaaagcgtggccaaacgactggaacttccgatagagaagtttccgattaacattgctgattatgggaataccgcggcagccagcgaaccgttgcttttagcagaactgatgcaggaacataaaatccaacgcggcgacatcattgtgttcagcggctttggcggtggtctgaccatcggaactaacgtaattaaattttaaaaacatattatttggaggaacataaaatgacaaaagaagaagtattcgcaaaggtacaagaagtaatcgcagaccaattggaaaaggatgcaagcaaaatcacaatggaaactagtttttcagaagatttagaagcagatagcttggacatctttgaagttgtggatcaattagaagatgaatttgatatcgacattgatactgacgaaaacatggataccgtaggcaaattagttgattacatcattgaaaaccaagattagttttagtcagtattaaggagagcgtaatggttaaagcagcatacttattcagcggacagggtcagcagtttgcgggaatggggcaagacttctataaaactgaaccagcttatcgggctttagttaatgaagctagtcaaattttagaccaagattttgcagatcctgcggtaatggatgatcccgtcaatacccaattagcgattgtaatttttagcttaggggtggaacgaattttacggcaggaaaaactgcgagcagaaaaatttgtgggactaagcttaggtgagtattctgcattgttagcggcaggtagtttttcattggcggatggtttagcagtaattggagaccgtgcgcgatacatgagtgaagctggtaaacaaaaccctggtcaaatggtagcggtgctcaacgcagaaccttcagtagtggatgaagcgctagcggatgcccgagaagttggtgacgtttttccagcaaactataatacgccaaaacaaaccgtttttggtggcaacgcagagggaattgaacgcttcagtgcggctttaaaggcggcgggcgtaaaacgcgttgttccaatcaaaatgccggtggcttcgcatactccgtatatgatgccagctagtgctcgtttagcagagcgcttagcaaacgttccggttcaggaaccgcaaatcccggtaattagcaatacgctgaaggcaccgtttaccgtaagtaatttgaaggaaaccttagcgaagcagttaacgaatccgacttactttacggattgtttaaatagtttaaacgttgacgaactagactgtcttattgaagtgggacctggcaaagcgttaagtggttttgcgaaaaaaacgttgaaaaaagcggaattaccaatttttaacattgaccgggtggaaaatttaaataaactacgcgagttcctagtgactaaacaagctaaggaaccggttatctaaaggtttacggacattgatagacacgaataggctgggaaaatttaatttaagttttctcagtctttaattaggaggccataataattggatattaaagataaagtttcggtagttactggcggaacgaaaggaatcgggcttgcaatcgctaaagatttagcacaacaaggtgcgaaagtctttatcaccgcgcgccgggcagttgaagacgaagcgttacaaaccgaactcaatgatttagagatcgtctacaagaatttagacatccgcgctgatgaagaagtgggggcattgcttaacgaacttaacgaagagcaaggtcacgtcgacatcgtcattaataacgccggcatcacccgcgataagttattgagtcggatgtcggtagaagattttgaagaagttatcgcgactaatctggtaggaactttttcagttactaaatacgcaatgaaaatcatgcaaaaacaacgttcgggaaacatcgtcaacatttctagtatttcaggaactcacggaaacgtgggccaagccaattattctgctagcaaggcgggaattgtaggtttgaccaaaacaaccgctcgcgaaggtttgttaagaaatattcggtgcaacgcgattgctcccgggatgatcgaaacagcaatgacgggaaaactaagcgacaaggttcgcgctaagactgaagaaatgattccaatgcaccgttttgggcaaccggaagaaattgccatggcggtaagctttttactgaaaaatgattacattactgggcaagttctgaccgtggatggcggattgaccctttaaatcaaggaggaaaatatgactagaagagttgttgtaacgggaatgggggcactaaccccacttggtaatagtcgggacgcctttattgaagggctaaatgaatctaaagtaggaatcgaccaaattactcattttgatgctgaacctactggaattacggttgctggagaagttaaagattttaacgctaccgaacgtttagaaagaaaaattgctaagcggatggatccgttttcccaatatgctttgtacacggcggtagaagccatggaacaagctgattttaaggatggcgaagtggatcccgaacagatgggggttatctacggctctggaattggcgggttaaccacaattcaagaacaagtaatcaaaatgaacaccaagggacctaaacgagtttctccgttgttcgttactaattcaatcacgaacatggcggcgggtaatatttcgatgtactttaatgccaaaaatactagtcaagcaatcgttacggcttgtgctagcgctaataatgccattggtaatgcgttccaccatattaaaaatgggtatgcggacgtaatgattactggtggtgccgaatcatcaattaatgaaatcggaattgccggttttgcggctttaacagcgttatcgaccgcgacggatcgtttacgcgcttcgattccgtttgataaggaaaggaatggctttgtcatgggtgaaggagccgctaccttagttttagaagagtacgaacacgcgaaggcccgtggtgcaaacattttagcagaaattgtcggctacggaatgactagtgacgctttccacatgacccagccagatcctgacggtcgcggagctatccgggcgatggaaatggccttacaagaaggaggcttaactcctgcagacgtggattacattaacgcccacgggaccagtacccacgctaatgatagtgcggaatctaaagcaatcgcgaagatttttgctgacaacgatcattaccaagtaagtagtactaagtcgatgaccggacatttattaggggcggcaggtgccattgaagccgtagcaaccattgcggcattacaaaatgacgtgatgccagtaaacgttgggcttcaagttaaggatccggaagtcaacattccgttggtaacggaagaaagccggcgaacaaaggttaatgcagcaattagtaattcctttggttttggcggtcataatgcggtattagcatttaagaggtgagaaaatggaagagattgatttagataaattattaactaaattggatcaatcgtcgtttacgtcatttgaaattcacgacggcgactttaatttaaaggttaaaaaagaagcagtagcgagccaacccgtaatgcaaaataatctaccggtagcggaagcggctccttccatgcctgaaagcgaaccgttagctgaaattaaggcaccgtttgtgggagtggtttattttgctccggcagagggcgaagatccgtatattcaagaaggtagtacggttaaaaaaggtgacaccgttgccttgattgaagcaatgaagatgtttaacgaagttcattcaccaattgaaggcgaagttgtcgaaatcctggttgataatggttcgatggtggaatatgaccagccaatcgctcggattcgcgaaaaataggggggcgtggaaatggtaaatgtacaagacatcattccccaacggccaccatttcaattaattgaccagttgattaatttagaagatggcaaaaaggcggttgcccaaaagcaagttaccatcaacgaatggttttttggccatcaaagcgaactatttatgccggaaccattattaattgaggcacttgcgcaaacgggggcctgtgcactactatcagcacccgaatttgctggcaaaaacgccttttttggcgggattaagtcggcaatctttaaccagcgggtggttcctggaaacgagttaaccctaaccgtggaattaaccaaactgaagcgtcaaattgggacgggccacggggtgattgaaaatgagcgacacgaagtggtttgtgaagctgatttaactttcatcgtgggctagaaagaggagagtattgatgtttcaaaaagttttagtagccaaccggggtgaaattgcggtacagattattcgttcgttacacgagctagatattcaggcagtggcagtctattctaccgcagatgaaaatagtctctttgtacgcctcgcggatgaagcagtctgtattggcggtccccaaccagcggaatcgtacctaaatacttttaatattgttaacgcagccattttaaccggctgtgacgcaattcatccgggctatggctttttatcagaaaatgctgaatttgcgcggttgtgtgaagaaagcaatttaaaatttatcggaccaagttaccaaacaatcgagttgatgggtaataaatcgcgagcccgtgaaaccatgattagtgcgaacgtaccggttatcccaggtagtaacgggatggtgcgggatttagaaaacgccatggtggttgcggagcagatcggttatcccgtaatgctaaaggcagccgatggtggtggcggaaagggaatccggcgaattaattcaccagacgaactaaaaaaagcttaccaagcggcgcaacgtgaagcacaaacttcttttggtaacgcggatttatacctagaaaaaattattgaaaacgccaagcatattgaaatgcaagtgattgccgaccagtatggacactacgttttcttaccggagcgagattgttcacttcagcggactaatcaaaaggtgattgaagaaacgccttgtgcagtaatctctcacacggaacgggaaactttaggtgaaatcgtggttcgggcggctaaggcaattaagtactataacaccggcaccatcgaattccttatggatcaagatcaccatttttacttcatggaaatgaacacccgcctacaagtggagcataccgttaccgaagaagttactggaattgaattaattaaggaacaaattaagattgcggaaggccaaaaattaagttttagtcaacttgacgtaaacattttaggtcacgcaattgaatgtcggattaatgctgaggaccctagtaacaactttatgccatcggctggtaagattgatcacctctttttaccggtggggaccatgggagtgcgaattgactcgggaattacccaaggaagtttaattccaccgttctacgactcgatgattgctaaaatgattgtaaaaatgccgactcgtcaagaagcaattgttaaaatgcgacgggttctaaaggaatttgaaattgctggggttaaatgtaacaagacgttcttagaagcgttgttagttgataaagggtttgaaaaggcacaattttcaactaaatatattgaaaataactttttgaaagagtggttgaataatgaaaagtaagttttccttgccaacccaagaagaaattgttaaacgcctgaagaaaattccagaaggcttgtggcgtgaatgccccgagtgtcatgagaagtattactatcgtcacgcgggtagcttagaagtttgtcccaagtgtgggtacggaatgcgaattggtgcgcgcaaacgaatcaagatggtctgtgacgagtttgaagagtgggataaagcccttactaccgatcctcagaacgctgacccaaagtatcgccagaagttagcaaacgggattaagcagactcgaatcaacgagagtgtcctaactggaaagggcaaaattggtaattttgcggtagccattgcggtgatggactcccggtttatcatgggaagtttaggccaggttaccggacaaaaaattgcccatcttttccaaaaagccactcaagaacgattacccgtaatcatctttacggcttctggcggcgcgcggatgcaagacggaatccattcccttatgcaaatggcgaaggtgtctgacgaagtggctcggcatagcgcggaaggcttgttatacatcgcggttttgacggatccaactaccggcggggtgactgccagttacgcaatgcaagccgacattattttggcggaaccgaaaaccttaattggttttgcggggcgacgggtaattgaacaaaccattaaccaaaaaccgcctaaggatttccaaaaggcagaaacgttacttaaaaatggatttttggatgcaattgtcgaacgcaaggacttaaaaagctacttaaataacttgttaagcctccatgcggaatgaataagtagggatgaaaatgacaaaaacagcatatgaaacggttatggcagcccgggccaaagaaaaggttgccaccgaagatttgattaataatatttttaccgactttactgaatttcatggtgatcggcaattaagcgatgatccggcaatcattggtggaattgcccgactaaacggtttaccagtgaccgtcatcggaacccaaaagggaaaaaataccgccgaaaatattgaacgccatttcgggacggttgaaccggagggctatcgtaaggcaattcgtttaatgaagcaggctgaaaaatttaaacgcccagtaattacctttgttaacacgccgggtgcttacccaggaatggatgctgaatatcacggccagggatcggcaattgcccaatgcttaatggtgggtatggagctgcgggtaccatacatcagcgtaattgttggtgaaggtggcagtggtggcgcattagccttggcaactgcggaccgggtctggatgtttgaaaacagcatctattcggtgctatcgccagaaggctacgcctcaatcgtttggaaagatgctaaacgagtggcggacgcggcggaagaattaaagctaacaccagagattctgctgaccgaaggaatcattgataaaatcattccggaagttgtcgaccaagaaagcacgaaagttttaaaaaatatgttagtttccgaagtggaaagtttacgacaattttcggctgacgaacttgttgaacagcgccacgaacggtttagtaaattttagaaaaggggttaccgatttggaaggaatacttagtggaaaaacaattattgtaatgggcgtggccaataaaaatagtatcgcttggggatgtacccaagcgatcattaaccaaggcggccgagtaattttaacttaccaaaatgatcgaattaaaaagagcttaagcaaatttgtagctcccgacgttcccttagtggaatgtgacgtggccgaagatgaaaatattgcagctgcttttgataaaatcaaggcggaatatggcgaagtcgacgggattattcacgcgattgcctttgccgacaaagaaaccttagaaggtggcgtaattaataccaaaaaggctggctacaatttagcgcaggacgtgagtgcctattcattgatcgcggtatctcgctacggcgcaaaaattatgaagaactcgggaagcattgtaacgttaacatactttggctctacccgggcaatccctaattacaacatgatgggaattgcaaaagcagcgctagaatctagtgtacgttatttagcaagcgaccttggcgaacaacacatccgggttaacgcaatttctgctggagcaattaaaaccttagcagttacgggaattaagaaacaccgggatctgctaaaagaatctcaaagccggacggtggatggcgaaaacgttactactgatgaagtgggaaacgttgcggcattcttagtaagtgatctggcaaccggagtaacgggtgacgtgatttacgtggataaaggtgtgcacctcgtttaggattattaaatttgcaattattatcggtacttttaaagccatagctggaatgctatggctttttgtggtgaggtatttttaaagaagtgaaaagtagcgataatttttagaaatagtatgtttatacatattggtagacaagctcttggcgaaactactaataaatcatccgactttattgttctgcctcgtcggtgctgtgtctcttcagaaaactttagtattgtttcaatattatcaggtacatctttgggggagcgcagaagattaaaaaattttttgaacatgactatccaggaatttgtagacgagcaggcaacaatccagcgggaatcagagccgttgtaataggtgggatgccaaaatcaccatcctttagtagtagctcggaagaaaaaagaatttatcgaaaaagttgttaatgaaaccagagctttggatgaaaaatcaaaggacattattatatataacatcattgaaaagcacagtaatgactgatgttatcgaaggttccatatgacctcatcaagatatgatgactataaaaaatatgcacacaacgcttttgcagattcatatgaataccagattttcggtggaacgaatctacatgaatacttatcgaattgaaaaaatcagaaaaagagcggaactttatcggaatttttggagtggaaacggctttaaaatgatagtgccgaaggattgggaataccattaatacaatgctccaatttgatttaggttaattattcgtccacttgtcccaatccttcggcaaagtgtaggtatagctcagttggtagagcacctgactgttaatcaggaagtcgcaggttcgaaacctgccatctacgttgcggttaaagccgtaaatgctccgagttgaaagctaaggcaaggcagatggtttgacgtgtggaaagcgtatgaggttcgattcctcattgccttattgccactgtagtggtatatctctagtatttttattcgcaggatagggtggaagctctatcttttttagtgtttaattaataatgcgaataaaaatatggagatggttaaatggaatggattaagtcaatactggagattctaaaattagataaaaagtctacatttgtggccgcaatggtttgctcagcacttttgatttttaaaggggttattgagaaacattttaatgctcaatatttttatgatcattttgaaatgtttgttttaattatggcttttataatgtgggccgtattattagcagattttttaatttttgttgagaaaaaaatcaaaataaagtggcaaataaaaaaggaacaaagatttttagcaaaattaaaagatcgtaggttgaaaattgtggctgaaatgtatttcacgcctaatcatagtaagcctctccaaattggggattcagacgttttatcgttaagttctcatggagtgatattgagaaccgcgcaacagacaacaattgactcctatgaagtaattaataatccattttttacacatattttacaaccgtgggccgtggattattttgataagcataaagggaagattaaacagtatgaagatgactaaatacggttggtgtagtttaacagagataaaaatattcggcgaactagatcgacaaatcaaacaaaataagaaggacgatccaaaaatggaccgtccttttattatgcctaaaaaagaaagagaaacaattaagattgattggaacaaaaaaacgagcacatagcctgccatccttgtaaatgttggcgtaatggtgataatcgacgttaaaacacttaataagttgtctaacaaagttattcccataataccaccttctttcataagaaaaaggatcagtattgctacgacaaggaatatggcatcgcctatatatggcaagctatatgttcgtttcttaactaattttactatcagtgacttgtttaatcaaatggaggtgtggtgatatgtaatgactaatcaagaacgagcagaaaaagattatctttctgggatgaagtacaaggacattgctactaagtatggcgtgtcgatcaacacggttaaatcgtggaagaaccgtcatgggtggcaacgtggatccaaaaagggtgcatctccacctgaaaaaagggtgcacacaaaaatgaaggtgcggatgatgaactaaatgccaagcaagaactgttttgtcaattagtaggtgctaaaaggttgccgttatatcgggcttatatgattgcatatcaagtagctgttgataccaatgcagttagagttaaagcttcacggctaagaagcaatcctaaaattgatgaaagaattgttaacattcagcgagaagtagcggctaaacataaatggtcgttggacacagtggttggagagttgacattcgtacatgacgctgccaaagctgacatcattatggatggattgcgaaaggctaactcagacgccatgctgaactcactcgaccgtattactagcttgttgcacattagcgatgaagggcgtcgtgctcaagctgaggcagatgttgccaagattaaagcagacgagttgcaaggcaaaggtgaggataatccaatcttgttagcaatggctaaacaagcacaacaattggtcaataaagaagaggaggataaagaatgaagacgtttatcaaggacattaattactcacctaaacaagctagttttatcttttccccatttgatcatttgtttgatgtcaatgagggttcaatacgtgctggtaaaacagctgctgatgatgcgcgtttagcgcttttttatttggtttcacctaacgaaacacatttggtaagtgcatataatcaagaattagcctacaaactgtttattgaaggtgatgggctaggattagcttacatctttgatggagtgtctcatttgcgacgtgaccgcggtggtgaccatttagaaatcgacttaccttctggaaagaaaaaggtctacttcaagggtggcggaaagtcgaacagtgccaattcaattcgaggcttgtcgcttggttcggttgcttactccgaaatgaatctcctagataaggagttcattgatgaatcatttcgacggacagcagcggctaagattcgctatcatttagccgacttaaacccgccggcgccgcatgacccaattatcgaaacgtttaaagaatacggcgctcactggttgcattggacaatgagtgataaccctgtcatgtcaaaacaacgtttgaagggaatggaagaacagctaaaacgaaatccatatctttacaagcgtgactggttagggctccgagtaatgccacaaggtgttatctattcaatgtttgatgataaagaaatgactgaccaaacattggttggtgaaccagtggagatgttcttcgccggtgatgcagggcaaaatgatgcgactacgttaagttgcaacattgtcacccgagtggttgacggcgatggtgcacgattcgtattgaatcgggtagctaactattaccattctggtactgaaacaggcgagactaaagcgatgtcgacgtacgcagaagaattacggcaatttattaactggtgccaccagaaataccaattatattattctaacatcgtaattgacccggctgttaaaacgttgcgggctgaacttgaaaggctaggcatcatgagtagtcccgccaataacaacggtaatgaaaaggttggttctgttcgtggcattgaagtaggaattgaacgcctacagaacttaatgaccaaccaacagttccgcctagtagagccaaacagtgatttgtatagccattatcacttcattaaggagttagggatgtatggtcgcgatgaaaacactggtaagccagttgatatgaataaccatgcaatggatgaagctagatatgcggctaattactttaccagccgatatgaatagaggtggactgaatgccagaaaacttaatctcaaagacaaaggcggtgttgcaaaggatgaatgtgttaccagttttaaatgaggtacaagaccataagaaggtaatgattagtgatctagacgttgcgcgtattaagaagtatcaacgtttatacgaaggcaatccggaatggaaagtgcggacgtttagaaatataaatggacagaccatggttgaacatctgaaaatgatgaaaaattaatttttctttagcttttttaagtgtttttgcgaaagcccgtcgcttttgctagaattacttgaattggttcaacgtaaaaattgggaggcactaattttgaatatcggaattgataagatcagtttttttactagcgacctttatctaccaatggatgatttggcaaaggcgcgcaatgaagatccgaataagtatttaattggcattggacagtctaaacaagcggttatccggaattcacaagacgcagtcaccttggcagccaatgcggcttggcaaattctcgatgaaaaagagcggcaatcaattgatttgattttgtttggaactgagtcgggagtggataattcgaaatctgcggcggtttacttacagtcgctattggggattaacgcacaggcaagcggggtagagtttaagcaagcttgttttggacttactgcaggaattcagttggcgatgggacatattgccctgcatccacaaagcagggttttactcgtcggtgccgatattgcccgttacggaattaagacggctggtgaaccaacccaaggcgggggagcagtggccatgattatgagtgctaatccgcgtatcttaaagattaatcctgaaagtgcgcatttgacaaaagacattatggatttttggcgcccgctttatcgtagtgaagcgctggtagatggtcactactcatcccaagaatttattgacttcttccaaagtacttttcaacagtactcagccaaaactgggcaaggacttaacgactttgcagcgttgattttccatttgccgtacacgaaaatgggattaaaagctcttcgaagcgtcctggaagaagcacctgatgatcaaattgccgaaggactattagctcgttttgaagacagtcgccagttaaatcgcgaagttggtaatttatatactggatcgttatacctcagtttattgtcgctattacaggcacgttcattacgtgaaggggatcaaattggtctctttagttatggttcaggagcagaaggagagttttatactggtgaagtggtgcaaggctatgagagaatgttagacacaagcgtttctgtgctgttacggcaacgtaagccagttagcgtaactgaatacgaggaaatttatcgtagtttcatggcggcgcaaccatcagattttgtaacggactatcaaaatgatcctgcccgttttgcgttaaagggacaaaaagatcagcaacgacaatacgtagaacgcaaagattgattttgtgcttgattactaattggctggtgctatttttgaaaataataaaggagacttccatttccaggaagtctcctttattaataagtttgaaatttactttatgatgcaagcgcgtcttcaactatcttgccatctttaacgactaacaaagctcggttactatcggtttgtaaaagttttaccgtatatccagcacctaactccttctttaaggattttgaaagtccagtaaattgtttctttagccctgcgtagctatctttatcaattgttcggggatcttttacccaagcactgaaagcttttttgctattcgcatcagttggggtaaccacgaatactttttgatctgcgttaaaggtgaggtcgcctaatggcttcaaatttttcttaagactagcagtaatgtttctttctttagcagcctgttgtgacgctgcctgactatcactgttcattttttcaaatttgtcgtctttaattgaggcttccttactttttttagcagccaaatgtgaactagctgtgctagcagctgtagacggtttttcatgaataacctggtttcccgaaaaaatgactagggctaggggaattataaaaagaataattgctccaaaaatggactcacggctacgaattgaagaatgtagcttaaagagactaagtattaacgcgattgatgctaaaactaaaacatataacataatgtcctccgaaatgattcattgccttgaccattagtatgacgggtataggcgtagaaatcaatagataactattaattttagtatatatcgcttctaaaaagtcccaccactttgcccaaaatggtgacgttgtccaaaataattgggctcatggtatcattttcgggttgcaagcggatgtggtcggtttctttaaagaaccgtttgcaggttgcttcgttttcgtcagtcatcgcaattacgatttcgccattatcggcggttgattgttttcgaacgatgacttgatcgcccgataaaatgccggcattgatcatactttcccctcgaatggtcaacatgaaaagatcgctgctttcatttttaaattctggtggaacggggaaaaagtcggtagcttcttcaacggctaggatgggttccccagcggtaactacccctaaaactgggatttgctcgtcattttcttgaataccaagcgcttctaagccttgagccgtaatttctaatgctcgaggcttagtaggatctttttctaagtacccatttttttgtaggcgattgatatgcccatgtaccgttgatgtcgaagataaaccaattgccttaccaatttctcgaacggtaggcggataaccttgcgtttggaccgtttgatagatatactcaagaacgttaagttgcttagtactcaaattctttatcattttttcaccccacgaatatttgatataattttaacatagacaggtgaacttctcaaacagatgttcgcattttactaaacgaaataaataaaggggagtaatagtaatggcagatcaagaaatgcaaaagctaattaaacggattaatgaattagcaaaaaaagcaaaagaagaaggcttaactgagcttgagactattgaacgtaaggaattgcggcaaaaatatttaaaacgatttagagaaagttttcggagccaaattgaaatgatgaagatttttgataaagatggtaaggaagtcacccccgaaaaggtaaagaaagttcaacggaaaaaaggcttacgtgacgattaaacggggcttttgtttttacttgtttttgtgtaaaatgaaaaggcagactgttcacgaggaggattgacaatgtcaactggaatttggattatgattgtaattatcgccgttcttgttggagcaatcggtggatttttctttgcacgtcgttacatggaaaactacttaaagaataacccaccaattaacgaagacatgcttagaacaatgatgcttcagatggggcaaaagccatcacaaaaaaagcttcatcaaatgatgaccgcaatgaagaatcaatcgaaaaaataaaaaagcgtccgttatttggacgctttttttgtatgggaaggctcggccatgtcaacatattggaacgttggatctaattcgcggtctaaagcagcaaatgccgcgtttaagtctttttccaattgggctaagttttcgtcgttcatccgagtttttcggtcaattacgattggctcaccaaaattaatttggacttttcgccggctaaatagcgctttaaacgaaagtggtccctgataaacagcgggaacaatgggaacgttagctagcttggcaatcacgaacgcaccgttttttaattcttgggaatggcgcgtgccagatggaaaaataatggttgagagttcacccttttttaaaattttgacgggcactttgattgccgatgggccaggattctgacgatcaactggaaaagcgttgagcttggtgattaaccattttaaaaatcggttttgaaacagttcctttttcgccataaaagaaaaacgctttgggtaagctgctaatgcgtataaaaccgggtctagccacgttcggtgtggtgcaactaacacgtacgaaccgcttggcaaccgatctttgtgatggaattgcgggcgcccgttaatcagcgttaaaagtcccgaaactagatgtttaataaatgtatacaacatatagaataacctttgctttcaatttgatattaatttgattatattatgaagtaatgggattgaaaaggagttttaaatggaagttaagttaaatgctgacgaacgaattgatcagctttatcgcgataatattcaaattattcaaagtcctagcgttttttcattttcactagatgcggtattgttagctaatttcgcggaagtaaagcaaagttccaaggcacaaattgttgacctttgtgcaggaaacggagcggtaggactttttttatctaaaaaaacccatgggcatgtgacaatggtagaaattcagtcacgtttagcggagatggccgagcgaagtattttacttaacgaccttaaagaacgctaccgcgtgttgaacctcccgcttgcagactcattaggaacaattaaaactgacagcgttgataacattgtttgcaacccgccgtattttccaaaccatccggatagtaaaaaaaatcctaaccagtttttggcaattgcccggcatgaaataacgacttccctcaatgaaattttggaaactagtcaaaaaatgttgaaaatgaatggaaaactattcatggtgcatcgtcccgaccggttaccggaaattattaatgactttacccaaaatcgacttgctcctaaacggattcaatttgttcactcgcatgagggcgacgaagccaacatggttttgatcgaagcaatcaaggatggcaggcctaatggagttagaattttaccgccaatcattacttatgacgggcttgaatattcaccaacagtaaaggaaatgttatatggaagcaccaagtgaaaacggtttttacttctacgtgctctggtgtgcagatcagacgttgtacacaggctacacggttaatttaaaacaacgggttgcccggcataattctggtcaaggcgctaaatatacccgggttcctaaacgtcgtccggttcagctgctttattatgaaagctttgaaaaccagcatgatgcaatgagtgcagaatatttttttaaaaaacaaagccgcaaagagaaacttaaatatttaaaaaataatggggtaatagtaactactttctcacattagtggtacatttatattgattaaaaaagaaaggggtaatattacaatgaagattattgcttatggaattcgtgacgatgaaaaaccatatttagacgaatgggtaacgaagaaccatatcgaggttaaagcggtccccgatttgttagattctagtaacattgatttggcaaaggattacgatggggtagttgcttaccaacaaaagccttacaccgctgatttatttgataagatgcacgaatttgggattcatgccttctcgctgcgtaacgtcggagttgataacgtacccgcagatgcactcaagaaaaatgatatcaaaatttcgaacgtaccagcatattctccaagagcaattgctgaattgtcagtcacccaactgttagcattactccgtaagattcctgaatttgaatacaaaatggctcatggcgattatcgttgggaaccagacatcggtttggaacttaatcaaatgaccgttggggtaattggtaccggacggattggccgtgctgcaattgacatttttaaaggatttggcgcaaaggtaattgcgtacgatgttttccgtaatcctgcattagaaaaggaaggcatgtatgtagatactttagaagagctttaccaacaagctaacgtgattactttacacgttccagcactaaaggataattaccacatgttggatgaaaaggcctttggtcaaatgcaagacggaaccttcatcctaaacttcgcgcgggggactttagttgatacacctgcacttttaaaggcgttagatagtggtaaagttgctggagctgcgctagatacttacgaaaacgaagtcggcatctttgatgtcgatcatggtgatcaaccaattgatgacccagtttttaacgatttgatgagtcgccgtaacgtaatgattacgccacacgctgccttctacacccgcccagcggttaaaaacatggttcaaatcgccttagacaacaaccgggacttaattgaaaagaattcttcaaagaatgaagttaagtttgagtaatttttctgcttgaaatgagttttaaggtaaggtaaaattgtactcgtcttatgaggccaaaaacacacttggttggaagtcaaaggcgtgctttgtgaggttgacttacgaagtcctgcgaccgtagataaccaaggaggaaaaaactaggaggaaaataacatgtctgttatttcgatgaaacaattgcttgaagcaggtgtacatttcggacaccaaacccgtcgctggaaccctaagatgaagccattcatttttactgaacgaaatggtatttacatcattgatttgcaaaagaccgttaagttgattgacaatgcttacaactttgttaaagacgttgctgcaaatgatggggttgttctttttgttggtactaagaaacaagcacaaactgctatcgaagaagaagcaaaacgtgctggtcaattctacgttaaccatcgttggttaggtggaacccttactaactggaacacaatccaaaaacggatcaagcgtttgaaggatcttaagaagatggaagaagatggtacttttgaccgtctacctaagaaagaagtagcacttcttaacaagcaaaaagacaagcttgaaaaattcttgggtggtatcgaagacatgccacacattccagatgtattgtttgttgttgaccctcgcaaggaacaaattgcaatcaaggaagctcaaaaattgaatattccggttgtagctatggtcgacaccaatactgatccagatcaagttgacgtaattattccatcaaatgatgatgctatccgtgccgttcgtttgattacttctaagatggctgatgctgttgttgaaggtcgtcaaggtgaagatgatgaagctgttcaacaagaagaagttgctgaaggcgtaagcaaagactcccttgaagacttgaagaagacggttgaagaaggaagcaacgaagaataattctcacttaggctgttgcgatttaagacctttatggcctgagatttagcacagcctttttttacggtttcataaaattaagatttaattattaaatgctaaggaggccataaaaatggcaagtatttcagctaaacaagtaaaagaattgcgcgacaaaattggtgtcggaatgatggatgctaaaaaagctttagtagccagtgatggtgacatggacaaggctgttgatttccttcgtgaaaaaggaattgctaaagcagctaagaagagcgaccgtgtagctgccgaaggtcttgcagatgttgagatgcatgataacactgcggcaatcgttgaagttaactcagaaactgacttcgttgcttcaaacgaccgctttatcgaccttgttaaggaaattgcatcacaagttgctcttgaaaaaccagctagcgttgaagatgcgcttaagttgaaatcaccaaagggtactttgaacgatgacattatcaaagcaactcaagttattggtgaaaagatttctcttcgtcgttttgcaactcttgaaaagagtgaaaacgaacattttggtgcttacctacacatgggtggtaagattgctgctcttgtattattagaaggtgctgacgaagaaactgctaaggatgttgctatgcacgttgctgctatcaatcctaagtacgttaaccgtgacgaagtaccaagcgatgtgcttgatcacgaacgtgaagtacttactaaagaagctgaaggcgaaggcaagccagctaacatcattgaaaaaatggtggaaggccgcttgaacaagttcttagcagaagttagcttggatgaccaagaatttgttaaggatcctgaccaaacagttgctaagtacgttgcttctaagggtggaaaagttaagtcattcatccgttacgaagtcggcgaaggaattgaaaagcaaacggttgattttgctgaagaagttcgtaaggaaatgggccaataaaaatcattatcttgcaaaaatcacggttgcgataggcgccgtgatttttttatgggtaatggaaagatttggtaccacggttataaaggaacttaatgaccctgaaccacatttgtgataaaatttattgaaggtaaaaaaacataggaggccgtaaaatgtctgaagttaaatacaagcgagtaatcatgaagctaagcggtgaagcgttagctggtgaaaagggaacgggaattaacccgcctgtaatccaaaaagtggctgaagaacttcgggacgtacatgacctaggagtgcaaattgcaattgtcgtcggcggtggaaacatgtggcgtggcgagactggtgaagaactagggatggaacgtgtccaagctgattatattggaatgttgggaaccgtgatgaacgctctagcattgcaagatagtttagaatctttgggagtacctactcgcgtacaaacatcaatcgaaatgcgtcaaattgctgaaccatacattcgacgcaaagcagttcgtcatctagaaaagaatcgtatcgtaatttttgcggccggaactggtagtccatacttctcaacggatacaacttccgcactacgggcggctgaaattggtgcagaggctattttaatggccaagaacggggttgatggaatttactctgcagaccctaacgtggatccaaatgccgttaaattcgaaagcctaactcatatggatattatcgacaagggcttgcacgtaatggatacaactgcaagttcgttatcaatggaaaatgacattcctttggtagtctttaatttaaaccaaccaggaaatattaaaaaggtagttgctggtgaaaatattggaacaacagtaaggggagaataaattggcaaataacgaaatacttaaaacagctgaagaaaaaatgcataaagcacaccaagctttagaacgtgatttaggttcaattcgggctggccgtgcaaacgcgtccctattagaccgggttacggtagattactatggagcaccaacacctttaaaccaaatggcctccattagtattccagaaccccgggtgttgttaattactccgtacgataagagtgttttaaacgacattgaacaagctttactagttgctgacttgggaatcaatcctgctaacgacggaagcgcaattcgcttagtaatcccacaacttacggaagaaactcgtaaagagttggccaaggacgttaaagctgaaggtgaaaagggtaaagtggcaattcgaaacgttcgtcgggaagctatggaagctttgaaaaaagctcataaaaacggtgactacaacgatgatgaattccacgatttagaaaaacaagctcaagatattacggataaagccatcaaaaaggtcgaagaaatcgtggctaataaagaaaaagaagtgcttgaaggataagttaatttgaagtgatttttagagttaaaactggaccgtagggttgttttaactcttttattttcacgggaaaatgattttatgccctttttttggtaaaataataaccattaacttggaggcttcttttaatgaaagcaaatcaacaaagtaaaataacgctaaatgaaaacattcctaaccacgtggccattattatggatggaaacggccggtgggcgcaacggcgctttatgccacgggttgcgggacataaaaggggaatggaagtagtcaaaacaatcactaaagcggcaagcagtctaggagtgaaggtgcttacgctttacgcattttcaacggaaaattggaaacggccgcaagatgaagtttcattcttaatgaagcttccaattaccttttttgatacctttgtgccagaattaatcgagcagggagtccgggtgaaggtcactggcaatatcgaaggcttaccacaagctacccaagatgcagtaaaccgggcaattagcgatactgcacatggaactaaaatgatcttaaactttgcgttaaattatggtagccgagatgagcttacccaaatgacccgctcaattgcacaacaagttgctaacggagaaattgttccggaggccattgatgaacaattaattgcgcggaatttgcaaactagttttttaggcgatttagcagatccggatttgttgattcgaaccagtggtgaagaacgcatttcaaactttctcttatggcaaatagcgtacagtgaattggtttttaccgatacgctatggccagattttaatgaacaaacctttatggaaatgattaaagagtatcaaaaacgcgaccgtcgttttggtgcgattaaaaagtgaggaattagttttgaaacaaagagtaattacggccgtggtggccttaataatttttattccaattattttgcttgggggaccatttattgaaattgctgctctagtactagctggagttgccatgagcgaagttttaatcatgaaaaaaattttgttagtttctccagaagcaattttgagtattttgggtactttatttttagtagcaccaaaagcatggctacatagtttacccagccagattaacactccggcgatttttatggtgtttgcgattgcgttaatgattcggaccgtttttagtaaaaatcggtttaactttgacgatgcgggcattctcacattaaccatgctttatattggagtaggatttaatttgttcgtacaagcgcggacgattggcctaggaatgattttgtacctactattaaccgtctggtgcacggacagcggcgcgtacttaattggccgtaaattaggaaaaagaaaacttgctccccaaattagtcctaataagacttgggaaggctccattggaggaaccgttgtcgcagttattgtaggagttatcttctcattattaggtgcaattaaccatggagtagtagcaaccgtgttatttagttttgttctttcaatcgcgggacagatgggggatttgattgaatctgcccttaagcggttctacggcgtaaaagattcaggaaagattctaccgggacatggtggaatcctcgatcgttttgatagtttgctattagttttacctatggcgtatctgtttgggttactttaacgaccagttaggagttattgatgattactacggtaattacttttttgattgttttttgcattttagttatcgtccatgaatacggacattttttggctgcaaaaaagtccggcattttagtccgtgaattttcagtaggtatgggaccgaagattgttgatcttaaacgacgcggaaccacgtttaccctgcgaattctcccaatcggcggctacgtacgaatggcgggcttggatgaagaagacgaggaattaaaagcgggacagccggtagtgttaacaaccaattctgcgggagtagtaactacaatcaatacttctgagaagtttcgttctgccgtcggtgtaccgttaatcgttactaaatttgatctgcaagacgcactcttcatcgaaggttacgaaaacggcgatgaaggtgcaaccaaacgttttgcagtcgatcacgatgcaacgattgttgaaaaagatggaaccgaagtacgaatcgctccccgtgacgtacagttccaatcagcatcggtttggcgcagactactaactaattttgctgggccatttaataatttcatcttagccatcgtggtttttgcgttaatggggatcttgcagggcgcggtgccttcaaattcaaatcaagttcaggtaattgataacggagtggctcaaaaagcgggcgttaggaataacgaccggatcgttgctgtagatggtcaaaagacgcagaattggtcggcaatttcaaaagccgtttcaagccaccctaaacagtcgataacgcttaagctgcaaaaaaatgggaagactcgttcggtgcgggttacccctaaggcggttaataatggtcaaaaaaaggtcggaatgattgggattcaatcatcaatgaccactaatctgggttctcgaattatgtacggttttacggggacttggcaaatgactaaggctttatttagtgctttagcacaaatgctgcacggctttagtttaaatgatctgggtggaccagtagcaatctacgcaaccacgtcaaaagctacccaacaaggcttcaatgcagttttatatattctgggattcctatccttaaaccttggaatcgtcaatttattgcccattccagcgttagatggcggaaagattttattaaacttaattgaagtggttcggcgtaagccaatgaaaatggagacagagaatatgattacactagtcggctttggtttcttaatgttgctaatgctgctagttacttggaacgatattcaaagatactttttctaaatgatttaaagggagtcgaattgaaaatatgaaacaatctaagattttaatacctacagtaaaagaagttccaaatgatgcggaagtgcttagtcacaaaatgatgcttcgggctggttacattcgccaaatttcggccggaatgtactcctacctaccaatggcatacaaggtaatggaaaaaatcaagcggatcattcgcgaagaaatgaccgcaatcgacgcggtagaaatgcttaccccagcggtgctgcctgccgagttatggaaaaaatcaggtcgttatgaaacttacggccaagaattatataaatttaaaaaccgtcacgaccgggattttattttaggacctactcacgaagaaactatgacaacgttaatccgggacgaagtaaagtcttataaaaaacttccgttaactttgtatcaaattcagatgaagtatcgggatgaagaccgtccccgttacggattgcttcgtggacgagaatttttaatgagtgatgcatactctttccacgcggatgaagaaacgctcgacgaaagcttccgtgctttcgagaaagcttatcaaaatatttttgaccggtgtggtctcaaatatcgcgaaattgttggagacgctggtgcaatgggtggtcatgactctaaagaattttctgcaatcgcatcgattggagaagacaccattgcttactcagaagaaagtgactatgctgcaaacctcgaaatggccagcagcgtttacgaagatttacaaatgcatgaaaatcccgctgaaattgaaaaggtcgctactggggatgcccattcaattgtcgaagttgccaaggaactcgatgtagatgctgggcgcctaatcaagaccatggttttgatggcagacgaccaaccggttttagctttacttcgtggaaatgatcaacttaatgaagttaagctgaccaacttgctgcatgttgatgaattacgggaagcaactgaagaagaagttactcgtttaactggtgcacattttggtaatttaggacccgtttttgataaacgaccagaagatattcaaattgttgcggataagtatgttgaacagatggtaaatagtgtggttggcgctaacgaagatggctaccattacactaatgtcaacgtgggtcgtgatttcgatgtagatcagtttgcagatattcgaactgttaaggaaggcgaattagctcccgatgggaagggcaaattaaagttcaccaagggaattgaaattggccacatctttaagattggaaccaaatattctaaggcattggatgcaaccgttcttgaccaaaacggacgtgcaattccagttatcatgggttgctatggtatcggggttagtcggttactttctgcagtttcagaacagttagctgatgaaaatgggctagtttggccgaagaatattgcgccatttgacgtgcacgtaattccagttaatgcgaaaaatgacgaacaaatgcaagttgctgaacaaattaatacagaattagttgcggcaggttacgacgttttgattgatgatcgtaaagaacgggctggagttaagtttgcggattcagacttgattggaattcctttacgtgtcacggttggtaaaaaagctagtgaaggaattgtggaagttaaattgcgtcaaactggcgaaacggttgaagttaagttggctgaattgaagaatacggtcgaaattttattaaatcaagcccagtaataattgggaagactgaaagctgggggtaacccagcttttaatcgttcatgccccagatattttttagggaagcaaaacctaaattaataagcactttaggaaattgggtattgtggtaccaggaggaccaaaaaattgagtttatcagaaaatgagcaatttaaaattttgctaaaacaaatagattggtcggccccgccagcggttggcgaaggactaattaagaatttaacggttcatgcaaattcgaaacgctggttttttaattttgagtgggacgatattctaccttatgatcagtttgcagaatttgatgagcggttgaaacatactttcaaacccattgcaaacgtagactaccaaattaccactcgggcaaatacaatcactaaagaacaagtagcgggatactgggattggattattaagcatagtggcattcaatcctcgttattacaggtactatgtgataaggcagttcctgattttcaagaccaagtattaacggttaaggtcgataatgaaatcagccaaaatttgcttagcgaagaagcgttacggacaattggacagaaatatcagcaagccggctttccccaatttaaaatccaggtagcgattgacaatgatggagccgaacaacgcttagcccaatatcacgaggaaaaaattaaacgtgataaggaaattgtccaaaaagcaaccgaggcaattaaaaaagcggaaaagaagaaggctaccgagaaaaaagccgctccccaattcaacgggaaggttcaaattggtaaaccgattagtgaccaagagcaggttacacagttacgggatattaaccaagaggaacgttcggtaaccatcgaggggtatatttttgatgtagaagttaaaactttgcgttcagaacggcaacttttaatttttaaagttactgactacacttcttcaattaccatcaagaagttttcacgtaatgaaagtgatgaacaactatttgcggcagtcaaacaaggactttgggtacgtgtgcgtgggagtgtgcaagaagatagcttcatgaaggaccttaccatgaatgcttatgatgtcacccaaatcagtcacgcagagcgcgaagatactgctgacgaaaaacgggttgaattgcatttgcatactaacatgagtacgatggacgctactaatagtattagcgactttgtcagccaggctgctaaatgggggcatccggccattgccgttaccgatcatgctgggttacaagcctttcctgaagcatatgccgctggtaagaaaagcggggttaaaccactttttggtgtggaagctaacctagtagatgatggggtaccgattgcttataacagtgcacaccgcgcacttaaaggcggtaaatacgtcatctttgacgtggaaacgactggtttgtctgcgatttatgacaaggtaatcgaactttctgcggttaaaatggaaaatggtaacgtaattgatgaattcgaagagttcattgatccaggatttccgttatctgaaaccaccattaacttaaccagcattactaacgaaatggtccggggttcactttcggaaaaggaagtttttaccaaattccgggaattttatgaagacgcgattattgttgggcacaacgttaccttcgatattggttttatgaataccggctacctacggcacgggatggaagagattaaaaatccaattattgatacgttaaccttagcgcgtttcctatacccaaccttaaaagggtaccggttaaatacgttggctaaaaagtttaacgtagctctagaacatcatcaccgggccatctacgatgcggaaacgactggacatctttgctatttgttcttaaaagatgctgaagagcgttatggaattgaatatcatgatcaactaaatgatcacatgacggaaaacgacgcgtataaacatgctcggccgaatcacgcagttttgattgccaaaacgcaagctgggttgaagaatctatttaaattagtttcgttgtcaaacgttaagtacttctatcgggtgccacgaattccgcgttcagagttagaacgattacgggaaggcatcattgtgggttctgcttgctcaagcggtgaggttttcaccgcgatggcacaaaagggttacgttgaagcacgggatcgggctaagttttatgattatttggaagtaatgcctaagccagtttaccaaccgttaattgaccaagaaatcgttagtgacactaacaaattggaagaaattatcggcaatatcgttaaattgggtaaagatttagatattccggtagtggctactggcgatgtgcactaccttaatccgcaagatgcaatttatcggaagattttgattaattctcaaggaggagctaacccgttaaaccggaccgaattgcctgacgtgcacttccgcaccacggatgaaatgctggaagccttccgttttcttggggaagaaactgcccaccaaattgtggttgaaaatcctaatcaaattgcggatagcattgatgacattagtccggtcaaggataagctatatacgcctaaaatgccgggtgctgaggaccgaattaagcagttggcaatggatcaggctcatgctctttatggtaaagaattgcccgaaatagttagcgagcggttagataaagaattgaccagtattatcggaaatggtttctcagtaatttatttaattgcccagcggttagtacacaagagtaacaaagacggatacttggtaggttcccgggggtcggttggttctagttttgtagctacgatgtctggaattaccgaagttaatccgttgctgccacactaccgctgtccaaactgtcaatattctcatttctatactaaaggggaatatggttctggatacgatttaccagataagaagtgtccagaatgcggtactttgatgattggtgacggtcaagacattccgttcgaaactttcttaggctttaagggagataaggttccggatatcgatttaaacttttcaggagactaccagccaattgcgcataactatatgcaagttttgttcggtaagaataacgttttccgcgctggaacaattggtaccgtcgctgataagactgcttatggctacgtgaaggcttacgaacgggacactaaccagcatttgcgtggtgccgaaattgaacggcttgccaagggagctaccggagttaaacggacgaccggacaacatccagcgggaattttgatcgtgcctgattatatggatatctatgatttcagtccgatccaatacccagcggatgaccaaactgcagcctgggaaacgacccattttgatttccattcgattcacgataatattttaaaaatggatattttgggccatgatgatccgaccatgatccggaaattgcaagatttgtctggcattgatccgcaaaccattcctactgacgacccgggagtaatgaaaatcttctccggtcccgaagtgttgggagttacagaagaacagattaaatccaagaccggtacgctaggaattccagaatttggtacgaggtttgttcgggggatgttagaagaaacccatccaaccacttattctgaactattacaaatttcaggactttctcacggaaccgacgtgtggttaggaaatgcggaagagttaattaaagcgggaaccattacgttaaaagatgttattgggtgccgggataatatcatgatggacttgattcattatggacttgattcgcaatcgtcctttaagatcatggaaagtgttcggaaaggtaaggggattccagaaggttacgaagaaaaaatgcgtgcagctaacgttcctgattggtacattgagtcgtgcgggaagattaagtacatgttcccgcgggcccatgcttcagcttacgtcttgatggcgttgcggattgcttactttaaggtttattatccgttagtttattatgcagcatactttaccgtgcgtgccgacgattttgatatcgtggcgatgtctcggggaaaagaatccttaaaaaaccgaatgcaagaaattaatgacaagggtaatgaagcttcagcaaaagaaaagaatttgttgactgttttggaattagctaatgaaatggtcgaacgaggcttcaactttaagatgattgaccttgaaaaatcggatgcggaagagtggttaattgatggcgactcattgattgccccatttaacgcgcttcctggtctgggattaaacgttgctaaacaaatcgtggcagctcgggccgataagccgttcctttctaaggaagatcttgcaaaacggggccacgtttctcaaacgctaattgattttatgaccgaaaataatgttttagcagggttacctgatgaaaatcaattgagtcttttctagattattttgcaatctttgcaaaacaatgctatattagagttagtaatttgatactcgttaagtgagtgagcagcgatgctcactctttttattggcaaaatataaatcgggaggttcaaatttgagtagcaatgttgttgaaaaaataacggaattagctagacccgttattgaaagtcatgatttccaactagtggaagttgaattcgtgaaagagggtcagggttggttcctcaggttttatattgataaagttggcggaattaacattgaagaatgcgccatggtcagcgacgaattaagcgaactcttggatcagcaagatcccgatccgattccacaagcttatttcttggaggtttcttccccaggagcagaacgtcctttaaagactaaggaggacttggcagctgctgtaggggaatatatccatatctcattatatgcgtcaatcaacaagcaaaaggtgtttgaaggatacctcaagagctttgaaaatgatgaattagttttagattacctagataaaactagacataaagaattgaaagtcgcttacaatcaagtggcgtttgctagattagcaatcaagatttagaggagagttaaaaatgagtaaagaaatggttaccgctcttgctaacttagaaaaggaaaagggaattaagcaaagcgtagttattgaagcgctggaagctgccctagtttctgcgtataagcgtaattatggtcaagcacaaaatgttgaagtagaattcaacgaacggaagggtgacatccacgtctacgctgtcaagaaagtagtggaagaagtggaagatgaccaattacaagttagtttagcagatgctttgcaaattaaccgggcttacgaactagatgatgaaattcgttttgaagtaacgccaaaaaactttggacggattgctgcccaaaccgctaagcaagtaattatgcaacgggtacgggaagcagaacgcgaagttatttacgaaaagtatagccaatacctcgatgaaatggtaactggtgaagttgctcgacgggataaccggtacgtatatgttgacttgggcggcgtagaagccgtaatgtctaaacaagaccaaatccctggtgaacaatacgaaccacacgaccacattaaggtatacgtaactaaagtagagtatagtggacgtggaccacaaatttttgtttctcgcagtcatgaaggattgttgaaacgcttgtttgaacaagaaatcccagaaatttacgacgggacggttgaaattatgtccgttgcacgggaagctggcgaccgcgctaaggtagcggttcggtcaaataacccggacattgatgcggttggaacctgtgtaggtccccgcggtcaacggattcaaaccatcgttaacgaattacatggcgaaaacatggacgtaattgaatgggaagatgacgatgcagaatttatttccaacgcccttaacccagcagaagtaatcgatgttttatttaacgaagaagaagaaaattcttgcatcgtcattgtgcctgattaccaactatcattagcgattggtaaacggggacaaaatgcacgtttagctgctaaattgactaactataagattgatattaaatcagaaactgatgctgctgaatttgttgaagaagatgacgacgaagaagtagcagattctgccactgaagttgaaagcagtgctgacgaaagcacagttgatgaaaatgtcttggaaagtgaatcaaacgacgatagcgacgaagaataagcccattggaggtacatttcaatgaaaactagaaagatcccgatgcgtaaagatattgtaactaaccaaatgtttccaaaacgcgagctagtccgggtggttaaaaacaaagaaaacgaagtgtccattgacccaactggaaaagctgctggacgcggtgcttacattggactagacgtcgaaattgctaagaaggccaagcaaaagcggatttttgaccgtacttttcaggttaaaatcgatgatcaattttatgatgacttaattgcatacgttgatcaccaacaggcccgtaaagaattgtttggggataagtaatgaaacccgcagttcaacaatatttagggctaatgcgccggtcgggaaacttgacgacggggcaagaattggtcttgaatttaattagaagcaaaaaagccaggctagtacttttggcagaagacattggagaatccagtaggaagagaattattgataaatgccatttttatgaaatcccggtagtcgttgctggctcaaaagcagaaatttcggcagcaattggacaatcgcgctcggtagtggcaaccaccaataagggtttcgcagaagggttcctcaagagattaaatgaataggagcgtgaaacgatgggcaaaaaaagaatttatgaattagccaaagaaatcaacgtttcgagtaaagaaattattgaaaaggctcaagcagatggtcttgacatcaagaatcacatgtcaacactcgatgccgattcagaaaagcaccttcgggaagcttttaagaaaaatgctggctccgaaaaaccggcagaaaagcggacaccgaagttccgctctagtaaaactggtaagaccgttgtgaaaaagagcggccaaccaaataaaaatggtgcgaagggtattcaaagattgaaatcaaacactaacgataacaaaaatacagatcatacaaaagaagaaaagcggcaaagtaataaccgaacacgggataaccgcaatcataaccaaaaccgtaatcgaaaccaaaataacggtcaaaatcggccaaagcgtgaacaaagcgaacgccaagacaagcaaaaggcgattcgggcatcagttgcggaagcagcacgaatggcagctcaagcaaatcgtgaaattgctcatgaaaagccccaacctgctcataaaaagcacgtaagaaataatgctgaacgttcacaagaacataagcgttcaaatcaaaaccactctaacactaccccgcaaactaacaagcggccggtggttgcggaagcagcggctgcacctgaagcaagcaaagaacggacaaacaataacaaaaactacggttctaagaacggcaaccgttttaacaataaccggggcaacaaccgtcctttcaacaaagaaaaccgtaaaaacaagaagaaaaaccgtaaggcaaaacgcgacggccgtttgaaagaaagccaaaagaaggtcgttacggctcgtaaagaaaagccgttgccaaaggtacttgaatatagcgaaggcatcaacgttgcggaaattgctaaaaagattcaccgtgaaccagctgaaatcatcaagaagttattcatgatgggtgtaatggttaaccaaaatcaatcacttgataatgacacggttgaactattagcggctgattacgggatcgaagcacaacaaaaagtggaagttgatatttcagatatcgacaagatgtttgaagatgaacaaaagaacacggatcatcttgaaaatcgtccgccagtagttaccatcatgggacacgttgaccatggtaaaactactttactagataaacttcgtcatagtcacattacagaaggcgaagctggtgggattactcaaggaatcggtgcttatcaacttaagcatgacgacaagctaattaccttcttagatactccaggacacgcggccttcactgaaatgcgtgcgcggggtgctgacgtgactgatatcaccatcttagttgtcgctgcagatgatggggtaatgccacaaactatcgaagcgattaaccatgctaaggctgcagaagtgccaatcatcgttgcggttaataagatcgataagccaggtgcaaatcctaaccacgtaatggaacaacttacggaatatggtttgattcctgaatcatggggtggcgacacgatctttgttgaaatttcagctaagtttggtaagaacttagacgaattactcgacatgatcttgttacaagctgaagtcttagaactaaaagctaaccctgaacaaaatgcggctggttccgtaattgaagctcaattggaccctggtaaaggttcaattgcaactgttttagtacaacaaggaactatgcacgtgggagatccagtcgtaattggaaacacgtttggtcgggttcggacaatgactaacgaacatggtcggcgggttaaggaagctactccatcaaccccagttgaaattacaggactaaacgacgttcccgaagctggtgaccgtttcgtagtcttcgatgacgaaaaatcagcacgggcagccggtgaagaacgggcaaaacgtgctcaaatggaagaacgcaaacgtaacaaccacgttactttagataacctcttcgattcacttaaggaaggtgaaatgaagaaggttgacatcattattaaagctgacgttcaaggttcggtagaagccttagcagatagtttacaaaaaattgatgttgaaggcgtccgggttaacattattcataaggccgtgggagcaattaacgaaagtgacgtcactttagctgccgcaagtaacgcaatcattatcggattcaacgtgcggccaacggcacaagctaagcaaatggctgactctgaagacgttgagattcggttacaccaagttatttacaaggcaatcgaagaagttgaatccgcaatgaagggaatgcttgaaccagtttacgaagaagaagtaatcggacaagttgaagttcgggaaacttacaaagtttctcggattggaaccattgctggtggatacgtaaccgaaggatttatcacccgggatgccggcgtacgcttgattcgggatggcgtggtcatttacgatggtaagttaggcagtctccggcgcttcaaggacgatgttaaggaagttaagcgcggatttgatcttggtctaacaatcgaaaagtacaacgacattaaagtcggtgatgtaattgaagcatatcggatgaaggaagtcccagtcgaatagtaagggggatttgaagatggctcgacaatatcgtgcagatcgtttgtcacaagaaattgaaaaagaagtcagtgacattttacgtcgccgagttcgtgaccctcgcgtgcagggagttacgatcacgggcgtggacgttaccggtgacttacaacaagcaaaaatttattacagcatcttatcggataaagcttctgacgacgaaaagacccgtaaaggtctcgaaaaggcgtcggggttgatccgcaaagaactaggtagtcggttatcaatttataaaacaccagaattgatttttgaaagagatcattctgtacagtacggtgaaaaaattgatcagctgattaataaacttaatcgtgactaagttaaaagagcaatcatggacaggaacgtttccagcaagtaagcagcttatgggaaccattccaggtcgaatggttgctctttttaagttagtgggagatactgattgggatgaacattttgtattccacggtatctactgtaaaatacttaagaagagcaaatttgcacgagaaatgtgaggtttattttgatggatggaattattccaattaataaggaacgcggaatgactagtcacgacgtggttgctaaggtgcgtggaattttaagaaccaagaaggtcggccatagcggtaccctagatcctagcgtggatggggttttaccggtttgcgtaggccgtgctacaaaagtggtagattacttaatgcgctttggtaaaacttatcaaggatcaattacgttaggcttggcgaccaccactgaggatctggatggagaagtggtggaacggcaccccttaagtaaaccactaacggacgctcaaattgatgcagccttaaagcaaatgaccggggaattaactcaaattccaccaatgtattctgctgtgaaggttaatgggcgcaagttatatgagtatgctcgtgccggagaaacggtggagcggcctaaaagaaaaatccaagtgtaccagtttaaacaaattcgccctacggagttcgacgaggaaaagggagaacaaactatttattttgaggtgcagtgtggtaagggaacttacgttaggaccttagcagtcgattttggtcggcaatttgggttgccagccgtaatgtctgatttaactcggacaagtagcggagggtttgaactaaaagagtgcgttactttggcagaacttgagcaggctcgcgacgaagaccgggtcgaaagtgatgtgctccatccgattgaccatgctttagcaaagtttgaagcaattgaaattactgattcagagtggcaattagttcaaaacgggggctttttgaagcgcgcgcttaccgaaccggttgttgccgttaagtataaaggtaaaattcaggcgctgtaccaatacgacgaatctcgtcaagtataccgcccagaaaaaatgttgttggtgagataaatgcaaataattaagatacatcatccgtatgataaaaaaatgattcccgaagaaaaggtggtgcttgctttaggattttttgatggcatgcatcgtggtcaccaagccgtaattcaaaaggctcgtgagattgcgaacgctaagggcttagcgttggcggcaatgacttttgatcaccacgcttcggtagttttccccaagccgcagcaccggtttagcgcgttaagctacctaacttctgtatctcggaaagcagagttaatggaagcggcgggagtggatattctttacgtagttaactttacttccgcatttggtagtttaaccccgcaagaatttgttgaccaatacatggtcggattaaatgctgaagtggtggtggccggttttgattatacttttgggccagttgccacggctaatatggatacgttgccagaaattgcgcaacaccgttttgaagtagttaaagtacctaaaatcattgcacaagggcaaaaaattggatcgaccgccattcgaaacgccgttgccgacggggagattgacgaagctaaccgatatttagggtacccctttgaaactaatggcttagtagtccacggcgaagcgcggggaaggaccctcgggtttcctaccgcgaacattgttagcaatcctaatcaaatcactcctgggattggcatttacgttgtggaaattaagattgccgataaatggtaccaggggatggcctcggtaggacgcaacgttgtctttggggacggtcgccccgtaactacggaaattaacattttagatttcaatcaagaaatttatggtgagacggtccgggttaaatggcaccaccgcttacggggagaagttaagtttgcttcggtggacgcgttaattgcgcaattgcaccaggatgaagcagatacgcgtgcattttttaagaagcgttaaagttgtctgaccaagcttgactaaagttgacatttctacaaacctctggtatcttaatagttgttcttagcactccgactttctaagtgctaaaagaggtgattttcatgttgactgatcgtgaattattgattttagaggaaattgttcaagaatatacggaaaatggtaaaccgattggttccaagacggtaatgaacaatctgccgattaaagttagttcggccacgattcgcaacgatatggctaaattagaggacctgggtttaattgaaaagacccattcttcttcaggtcgggtcccatcgctaatggggtatcgttattatgttgatcacttgcttcgcccagaagaagtcgatcagacggaagcactacagattcaaaggggactagcaactcatttccaagaagttgacgacattgttcgaacttcagcagaaatgctttccaatttaacacattatacagctttaacgcttaagccggagcaaaagggagccacgttagacggtttccgaatggttccgttaggcggcaaccaggtgatgctgattttagtttctagtaatggcgacgttactagccaacagttcagtattccacacgagatgaacggcgaaatcttagaacgggtagttcgcatcatgaacgaccggttggtaggcaaaacgttgagccaggtatattaccatttgcggacggatattccgcaggtagtggaaaaatacttgcagagtgatgcaggagttttggacgttttccaagacatcgttacccgctcaactcgcgaccgctatttcgtgggcggcaaattaaacgttctaaacttttcgaagaatgtggatgtaaattcacttcgggggttactaacgctgtttaatgaaaatgagcaaattgacggactgctaggtaataagcggagtgacttggatgtgaaaattggcgacgagttaagtaacgcgttgctaaaggattttagtttaattacggcaacttacgatgtggggagccgtggtaaaggactaattgccattcttggtccaaccagtatgcagtattcgaagaccttgggcttgatcaatacgtttaggtaccaattatcacacagaatgctacaatactataagcatcttgatgacagttaggaggattgaattggcaaaggaagacgaaaaggcaaaatcagcttcaaccgaagcaaaggttgaagaagaaagtaagggcgctgacaagcaagctaaagcaacgtcccaagacgaaaagaataatcaaaaggattccgcaaaagattcgaagcaaactactttagatcctgcggaaattgaaaaaattacggcggaacgtgatgagctttccgacaagtatatccgcgcgcaagctgaaattgtgaacatgcgccgtcgcaacgaaaaggaacaagctagtcttttaaaatatgatggtcaaaaattagcaaaggcaattttacctgcgttagataacttggaacgagctttgacagtggaagctgagcattcagaacaactgttgaagggggtagagatggttcaaaaggatctcttaaaagcccttaaagaaaatgatatcgctgaaatcgaggcagatggtcaaaagtttgatcctaacctccaccaggcggttcagaccgttccagcagacgatgaccatcctgcggataccgtagttaaggtatttcaaaagggttatattttaaaggatcgagtattacggccagcgatggttgttgttgctcaataaaagatagagaaagagggattttagacaatggcaagtaataaaattattggtattgacttaggtactacaaactctgcagttgctgtcatggatggtgacaaacctaaaattatcactaacccagaaggggcacggacaactccatcagtagttgctttcaaaaatggcgaaacacaagtgggtgaagtagcaaagcggcaagcaattactaaccctaacaccatttcttcaattaagcgtcacatcggggaagctggatacaaagtaacggtagacggtaagtcatacaccccacaagaagtttctgcaatgattttgagctacatcaagaagtttgcggaagactaccttggtgaagaagttgatcaagccgttatcacagttccagcttacttcgatgactctcaaaggcaagcaacaaaagatgctggtaagattgctggtttggaagttaaacgaatcatcaacgaaccaactgcttctgcgttagcttacggtttagataagagtgacaaggatgaaaagatcttggtatacgaccttggtggtggtacttttgatgtttcgatccttgaactcggcgacggtgttttccaagtactttcaacaaatggtgacactcacctcggtggggatgactttgaccaaaagattattgattggttagttgaaggcttcaaggaagaaaacggcattgacctttctaaagataagatggctcttcaacgtttaaaggacgctgctgaaaaagctaagaaagatttgtctggggttagcgaagcacaaatcagcttaccatttatttccgctggcgaagctggtccattgcatttggaaaagactttgacacgggcacaatttgatcaattaaccgcagacttagttgctaagactaaggtaccagttgacaacgcccttaaagatgctggcctatcagcttctgacattgaccaagttatcttaaacggtggttcaacacggattccagctgttcaagaagccgtaaagaactggacgggtaaggaacctaaccattccattaaccctgacgaagccgttgcccttggtgctgctgttcaaggtggggttttaactggtgatgttaaagacgttgttttacttgacgtaactccactttcacttggtattgaaaccatgggtggcgtgttcactaagttaatcgaccggaacactacgatcccaactagcaagtctcaaatattctctaccgcagcagataatcaaccagctgtagacattcacgtacttcaaggtgaacgtccaatggcggcggataataagacgctgggtcgtttccaactaacggacattccagctgctccacggggagttccacaaatcgaagttaaattcgatattgataagaatggtattgttaacgtttctgctaaggataagggtactggtaaggaacaaaagattaccatcaagagttcatcgggtctcagtgacgaagaaatcgaacggatgatgaaggaagctaaggaaaacgaagaagccgaccgcaagcgtaaggaagaagttgaccttcgtaacgaagttgaccaattgatcttcacaaccgacaagactttgaaggaacttgaaggtaaggtttctgaagacgaaatcaagaaggctaaagacgctaaggaagctcttgaaaaagcacaaaaagataacaacttagaagaaatgaaagctaagaaggatgatttgagtaagattgtccaagacttatctgtaaagctttaccaacaagcgcaacaagcacaaggccaagctgatggtgctcaaggtaacgaccagaataccggtaataacgacgacaacactgtcaatggggatttcgaagaagtcgatcctgacaaagacaacaaataaataagtgattagcaatgaagggtcgaagtcgttgactttgacccttttgcggtgattaacggttaaaactggtaaaaatcatggaggatgaatatggctggaagtaaagattactatgacattctgggagtcagtcgcgatgcatctgaagatgaaatcaagaaggcttatcgacgcttgtcgaaaaaataccatcccgatatcaacaaagagccgggagcggaacaaaagtttaaagacattaacgaagcttacgatgtcttaggggacgcgcaaaagcgtgcgcaatatgatcaatttggttccgcggacggcaacgctggttttggtggcggtggtttcggcgaccaaggcggctttggtggttttggcggcggattcgacgacattttcagttctttctttggtggtggtcagcgacaggccgctaaccagccacgacaaggagaggacctacaataccaaatgacgcttaagtttgaagaagcgattttcggtaaaaagtcgacgattaagtattcacgagaagctgaatgtaagacctgtggcggatcgggtgctaaaccagggacttcgccagaaacctgtcataaatgtcacggaacgggtagcattcaagttactcaaaacactccgcttggtcggatggttcggcaacaggtttgtgacgtatgtaacggaactggtaaagaaattaaagagaagtgcccaacttgtggtggtactggacacactaagcaagaacatgaagtaaaggtttctgttccagccggtgttgaagatggtcaacaaatgcggcttcaaggtcaaggtgaagctggttataatggcggaccttatggtgacctttacatcattttccaagtacagccaagtaagatttatgagcgcgaaggttcagaaatttactatgatcagtcaatttctttcgtacaagctgcactgggggatgaaattgaagtacctaccgttcacggcaaggttaagctaaaaatcccagctggtacgcagacgggaactaacttccgcttgaagggcaagggagctcctcgtttacgaggcaatggcaacggtgaccaacacgtccacgtgaaggttaaggtgcctaagaagctgaatgcgggccaaaaagaagctttgaagctctttgctaaggcgagtggggaacatccgtcaggcaacggcaagggcggtttctttgataaatttatgaattaattaaattgaagacaattaaaaacgttgaaaataggggattgctctattttcaacgttttttgtttatatttaattcaaaatcgccgttcctaaagtcaagtaggtagcaaataagatccagatcaagtacggaaccattagactagcggctaatttactagtttgccaaaattttttcacacaccaaatcactagtgcatcgagtacgatgataattaaaaagctgatccaacggttgcttgcgccaaagaaaatgatgctccaaatgaagtttaaaactaattggctgataaacaaaatcaagttattttggcgtgcattggtccggtcacgaagaattaaataaccgacaattccaatcattaggtataaaattggccagacaatgccaaaaataaagtcaggtggggctaagggcggcaacgttaagttgttataaattgctttaatatcacctgataatatccccgataggcttccgaccaattctacaacgataatgctggcgattaataagatccaatttggacttcttttagtcattaaatcatccctccttcaaatttaaaacggttacccggttagattagcttaagggtaacaaagagtcgatagtttgcataatgatttgcttaaaaaggcacgccataattaaaagaggctgaaaaaaatatcttaggaggttaactttaataaagtcaaaagtcagtttacgctgtttaacataaaagatattctaatgcggggggctcagatctagacattcaaaaatccctccatgattaacagataaattatgatatttcatctgtcagccacaaagggatatcacatcatgcccaatccaggcatcacgtcgatttttaattaatactgataagctacccgacttttagtgcacgctttcgtaaagtcgtagtgcaaaaaattaacgattgttgtaacgtgcgtcgtcttcggggcgatgactaagcatcccgaggaattttaagctgtatagggcgcttaaacctactaaaatatatacaattttagagataattgctgtttgcccgccgaataaggtagcaactaggtcaaattggaaaagtccaaccaagagccagttaatacctccgacaattaccaagattaatgctgtaagatccaatgctttcataataaatctcctcccataaggttattatttttggaacaccttaagcttagcaaattcactaatggttaagctaagaatatgcttaaccatgcttataaaaaatatttttttctcacaaattgcgttgagggaaatcgttgccgatgttaagcttattctgtagatgaaaacgctattttattaagacttaagtgcgggaggtaaaaatgcaagatattccaaaagttgttcgggtagcattgctgccgagtttatttctgcgagtagaatttgctgatggtgcggtgaggtattggcgttcggcgatcaatgagacagagctggacttgttaaaaaaagctggaaacctgcgtaaaggacttactcaactaacacctgagtactactggttaggaacccaagctacatttggccaagataacacgtttgcaattaaccgggttatctatgatggtaatgagatttacaaacaagggaatcggcaaccaacttaaatttaaaaaaataaatcaataaaggaccttgaggttgcattaatgcagcctcggggtttttatttggttaaattaaaatatgaggttaatggaaaaaggcttgcatttttcatgtcgaatcagttatagtgtaatgtataaatagaacactataacttaacggaggttgaaaattaatgttggaggtaaaacagcttgatgtatttatcggtagaaaacaaattatcaaaggggcgtcttttcaagttggcgatggggaaattgtcggcttgattggaccaaatggagcaggaaaaacgacgattatgaaaaccatcttagccttgacaaaatttaaggggcaggtcttggtaaatcatcaaacggttacctcaaatcatcatcaagcccttcttaaagtaggggcgctaattgaacaccccgcgttgtacccatacatgacgggccggcaaaatttggctttgtacgcacaaagcgaggtcgaaattgatgaactcgcacgtgcgttggaaatggaagcttatattgacgcacgggcaaagggatattcgttaggaatgaagcaaaaattgggaattgcgttagcattattaaatcacccggatctagtgattttggacgagcccatgaacggactcgacgtggaagcgaccattttagttcgtaatctaattttacggatgtcccaaaaagggaccgctttcctgatttctagtcatattttaagcgagcttaagcgggtagtttctaacgtggttttgattaataaaggcaagattttattaaccgattcattaaaaaatttccaaagcggtaattctcattattaccagattacaaccgacaatttatttgctagctatgaattattggaaagtcatggggtggtaagcgagctacataaagattatttaaagatcaatgctccagatcttcaagcagccgaaaaactgttggtagaaaatgagcagtacttattaacggtggctccagaaaaactaacttttgagcagcaagtggtgaagtcgctcagaagtcgccaggaggtgcgctaatgagaagcagtttgcaacaagagttctataaattcattcatcgccgaggctactggggcggcatcgtagccctttggttgcttatggccgtttcggtttggcttgaagggacgacgtttgattcagttgcccagagctatgattggggtagataggctgcgctggtgatgagtattttggtagcaactgattttggcggggaatacgaaaatgaaaccattgacacgttattttataagaacaccagccgtggcggggtttttcttgctaaattactaattctactgggttacgtgcttattttaagtttggcaggaggaatattcacaatggtgattcaggtaacctgtgctcctagtaccttgacatgggatttagtggtaaaccaccattccctttggaatgccacgcttttgacggggttaggagcctccgggatggttgctttaatcaccgctttaaccatcgggatgacttgtttaacccggagtaaaatcgtggctatgggatttagtttcgtattgatttttaccgggccaaccttggcaggggcactccccaaaattattgatgggccgtggattaagtggaaccccttgaacatgttgcaacttgcaagtcaggtcgcgaatccggctttaaagagcgttactaaattatccactgcgcaactagcttggggaacgacaatttatgccgttatttttaccatgctaagttacctgttttttagtcggggacaacgaagtaaataggaaggtgaaattttgataaccgttattaatcaagaagcttataagttgctacataaaaaaataacttggcttgcaccgtttttaatagttttactaatgattcctttcatcatgtcttttgatgatgccatttcggctccctggctggtaatgtcgagtttcggaattgatgaaattgcccctttgataatgattttagttgcggcaacctttttttcatcggagtttaagcaacgaacaatattgacgatgttagcaaaaacccccagtcggaaggatgtctatttagcaaaattaaccgttgtcgggctttgtgacgttgcgatacatggttttgcgataataatgaccctaattttaaattatgcgctaccaaaatttcgcttagacttatttaaaccgtatttgtatcaccaaagtcttttaactaacgtgctaaccatgaccctggttgatattttggtaaccatgttcttagtcagcattctcttcttaatttcttgttcgattactgaaaatgcggttgttttagcaatcagtttaggagttttctttatggggcaaattgtgtctcctggaatccaatttttaccacagcaatatctccactggctccgttggaatccattaaatatgatgttgttacccttacaatacgcaaattacccagtgtatcacgatatgtcgcacctttcgacgttgcaattaggggtggcaaccgcgggatatgccatcgtctttgccattttgggttaccaaatttttcggcggcggcattactaagaaggctgttccttggttaaataatacttttgaatttggtccataagaatggttgttttgggcgaaggcggaatgtccgctggaaaaaccaaggcaagcgcttgttttaaaccaggttcctcaactgaaatcacttttaagtcggcatggccggctttttgtgtttcaaaaaaggagcgggtgacgagtgctatcccggttaattggctaagcgagctaatgcaggctgaataagaggttacttcaactaggtattgaggcgacaaatgttgatttaaaaacagttggtcgagggtttgacgaatggcaaattgcggatctaaaacaattaatggtactttggtaagttgcgtaagcgtgatgttctcgtgagtgtggtacggccccgttttagtggtaacggcaataatttcgtcggtgaataagtaacggtaattaatggcgggattatgaatgggcaaaaaagctattccaaaattaatttcagcgtttaaaagctgtttcagggtgctagcagaggtattttctcgtaacgtgaatgacgtgtgtgggttaattttttgaaatgtcttcaacagtggcgttaaaagatgggttccagacaaaccaattttaattgaggcaggttccgaacgtggctgaagcgcctgtttggtggcacgaacttgccgtaaaatcttacgggcatgggattgtaaaatcaggccagcattagtaagcatgatgtggcgcccaactttcaaaaataatggttgtccaatttcccgttgcaaattactcatttggacactcagggtaggttgagcaataaatagccgttcggctgcttggtggtaattaagttcttcactcaaaactaggaaatactctaactgtcttaaattcattaggaggcctcccatcgatagtaaaaattaattactctaatagttttttgagaattgtttctttttgcttttaatcttatcatgtttttgaattatatttgtgaaatttttaactttaggagagtggcagatgaaacagaacttgaatcggtgggtaatgctcacggcgcatgtgctaattaactttgttttaggcggagtttacgcttttagcttttttaaaacgcctttaattgcgcaatatcattgggatccggcagttttatcattagcgttttccataaatatggggatcatccccctacccatgatctggggtggggcattaattgatcgtggacatgggaaattagcaattgtgttaggtggagtcttgttttcaattggattcattctatccggatttgtaaaaacattaccgttgctattattaacatacggtttaattgcgggaataggaagcgggttggccttcacgggcaaccttaataatgcaattaagttttttcctgataaacgggggttagcttcaggctgcgttctggccggcgttggcgtgggtacccttttatgtaccgcgctagcgcagttcttcttgaccaagatgaatattagtcagtctttgttttggctagggatggtttatttagtagtgatttttgtagttcaatttttcattcgcagtgcaccggccaaggatagcaaacagctggtggcttctaaaatggaccaaaactggcggggaatgctaaaagaccggcgtttttggctgatgttttggaacatggcctttggtgtgttttctgggatggtcattagtagttcgtcggcgcaaattgggatgggagcgtacggcttaactgctggtgcggtggtagttagtggagtttccattgctaattccgtcggtcggctaatctggggaacggtttccgactggttgggtgagtaccacactttagcactagtttacgcactaatggtgctttttatgggcttactactgcttggtaagggaaatacaagccttttttacgtttgtgcattaggcatcggcttttgctatgcaggtgtgctagctgtttttccaagtatcaccagcgctaattttgggctacgtaaccaaggattaaattatgcatttatttattttggttttgcaattggcgcggtggttgccccatacgtaacggccgctttctttaagtatacgtattcttttgcaatcgtctttatcattgcaatggggttgttagttttaggagtactcgcaatttatttattaaaggcttgggataaagaggctttacaaagaatcgaacaaaaaggagtgaaaaaattatgaaagtagcaattgcaggagctggcgcgatggggtgtcgttttggcgcgatgcttgccgaggctggtgtgcaagttacgttaattgaccaatggcaagaacatattcaaacaattaatcaatcaggtttgcgagtggaaaatgagcaaggggctcaaaactaccatattccagcactttttccagaacaagcaactgggcgatttgacttggtaatcgtctttaccaaggcgatgcagatggcggattttctgcacaaaatcatccccatcattgatgaaccaaccaccttactttgtttatcaaatggttttggcaacgaagaaactttaagacagtttgtctcagcagaccaaattttaattggggtgacactatggtcttccgagctgctaggaccagggcaaattaaagcaacgggagaggggcgcattgattttcaagccgtttcttctgattttgctccagcaaagttagccatggtgctaaatcttttgaatgaagcaggactccaagcaagcttagccaaaaatgttcacgaatcgatctggcgaaaagctggttttaacagtgtgattaatcccttatccgccttattaaattgcaacgtggcggaatttgggcaattgaattacggaacccaacttaccgatttaattttagaagaaattaatgcggtagcacaggctgaaggaattccctttagtgtaaggataattaaacaaatgctggaagcacagttcgatccccaggctagtgggcaacattatccatcgatgcatcaagatttgaataagcaacgcctcacggaaattgattttttgaacggctacatagtcaaactaggccgaaagcatcaactcgccaccccagtaaaccaaatgattacgggattaattcatagcaaggagcaattggggcagttaaggggagcttgatggacagaaaaatttgtttaataaagctgttttgaaggtcccttaaataattaggtggttggccatattttagaaattgaggaggtactttaatttctgaatccggcccttagtctaataaaagggggctttttaattcactatgtaaattaaaacaaaggatgacttttctaaaacagacgggtaagatgaggagggctagttaaacggattggttagaaactttaataaaatgctggaggtaggcctgaaaatttaactatttaaccaacgcttatcagcccaggcggttcgcgaaatcccgcctcaaattaaaactaagagtgatttattgatgagtaaaattaaccgtaacattgcggcaactggcgtagttgcggcgctttacgtggcaatcacgctaatttttgctcccattagctatggagtagtacagttaaggttgtcagaaatgtttaaccatttagccgcgtttaacaagcgctatatttttgcggtaaccctcggcgtgttgattgtaaacattttcagtccgttgggagtggtggacatgatttttggtacagccgggacgctaatcggaactacgctaacctactttatggcacgaaacatcggtgccaaaccacttaaattcttaatcgctacgctctgccaattacccggaatgtttttagtggatttagaaatgcacttatacatgaatttgccgctctttcccacttactgggttttagccctgggggaaattgcatcgatggcaattggcgcggtgattatttacctaattaccaagaaaattaacttatatgaataatttataaattaaagagggatttaaatgacttttgaaaaaatcttaccaattttaaagcaaggcggaaaggcaatttgccaacaatggaacggtgacgaagagtttgtaatcgtggtggaaaaccaaacgtttgcgggggttccagtaaccccgtatatgctaattaagaccactagcgagggatactccagctttgcgcccacggtatgtgacgtgttggcagatgattggcaggttgtagaataatgtcgcagatcaccgagtttaccgattgacaagtagtggtgaccggaagcaattctggaattgggttagcacaggcccaagcctttttagaacaaggcgcccttgtgtggagatttgatcaaaacatcgatcaaatggaccaaattcaaaaacaatatcccaaccattttaaatttacgcaagtggacttgtccgatcccttagcggttacaaaagccctccaacctttagaaaggatctacattctattaaatacggccgggatgctagacgactacttaccaatcgaagacacgactttaaccctatggcagcggatcctcaataataacgttaccagtatgtttaacgttaccaaaaccgcgttgcctaaaatgaagcattctggagtaattattaacatggcttcaattgctggaatggttgcgggaggcggaggaattgcttataccgcttcaaaacatgccatcgttggttttacaaagcaacttgcaatggattgtgcacctaaggggattcgagttaacggaattgctccgggatgtattgataccccgatgaacgcaaaggattttgcggatgggggtgaaattgctaaggcagttgctcaagaagttccggtaaaacgttgggcaaagcccactgaagtcgccagcgtgaccctattcttggcgagtcaggcagcaagctatctacaaggagtgatcattcccgtggatggtggttgggtagctaagtaaaactattggaaatttttataattaataataaaacaacctggttgctaaagcacgataaggcattagcaatcaggttgtttttatctgggattggatttacttaagcgctaatttctgcgctatcagttgtagctaagatagcagttactagtttttggtagtcgtccgtaacgacgagctgctttcgatagatggattccataaaggcggtatcaacaaaattatccagtaaactaattaagtgatcatagtatccgttaatattcaaaataccgacttttttaagtggaaccaatccaattgccatatcggacaacaattgactaacttcttctaaagttcccaaaccgcctggcaaaactaggtaggcgtcgcccttattgattaataactcttttcgctttgccatggttttggtggtgataaaggaagtggtgtttttgcgcggtagctcatcttcaaaaagaccttcgggataaatcccggtcactttgccaccgtggtctagaacgccctggctaattgcccccatggttcctgaggtggaccctccgtaaactagttcaacgtttttttgagctagggtagtgccaatgttataggcaacctctttaaaactggggtgatttcccggtcgggagccacaaaataccgttattttcacaaaaattccctcctcgttttcgaagtgtctagtataagacattttaaacgggggtgtcaatgcataacgggtaaacaatttgtactcgttgggctagtgataagtcaattccgcgcacgaataaaccgattgcgatactttaagggagtagaattcatttctttagcaaagacgttggtaaaatatgccgaggatgaaaaaccacattcttggctgatttgagtaatatttaacgaactttttcgtaaaagcgaacaggccttctgcaattttaactggtgaacgtactgactcggttttttaagctaaagtaaaaaggctagctaagttgattaacttatagctagtctctcgtagttcatttatcgacgtcgttttccgtggcgaccgactggttttacgaaaaaattcaaattaggtcggaaacgccgttttccgcgatgttcggatggcaccgtggctgtccgcgggtgttttttacgccaaagtaggtacccgcctacaataataattagtaaaattaatgccgtccaaaggcccccgtgatgttcgttgtactcaatccctgagctatgcgaagtatccgattcgaccgtggtaatgattttacttttcttagctttatgtgccttagaagaagacgagtttttagcagacttcgacttttcagacgattctttactggattcatccgtggactcgtcatctacggtcgatgatgagggggcctggttttgattgccaaagttgtattcgtgtgattgccaccgccaatttccgttgtggttggtttgggattgacgttccgcgggacgcgaactcgatttagcagacgaagaaggcgccgatgatgctggtcgactgcttgcgtgactttgtgcgggcgccgaactgcttggttgggactgacgcggttgcgaacttgattgatggttttgattggaattgtgattattattattttgggtagcgtgacttgaagcagcgggactactagtagtttctttactgcttgattgtgtttgcgttaccttttgttcattttcagccattgaatctacaagcctttcattgagattattgacataatgccttaaaattacttatttaattttagcatatttctgaaaatgcgaaaccttcgggaattagttggccggagcatttaaatttttgcgggaggtctgctataatttagcttagtgattacttatgaaaaggaaactatctatgaacgaatataaagatttaaaagaccggcaagcgcacatccggaatttctcaattgttgcgcatattgaccacggtaaatcaactttagcggaccggattctcgaattaactgatacggtcgcaaaaagagatatgcaaaatcagctgcttgatactatggatttagagcgggaacggggaatcaccattaagcttaatgcggtagaattgcattacaccgctaaagatggcgaaaagtacatcttccatttgattgacactccgggacacgtagatttttcatacgaagtttctcggagtctggccgcttgtgaaggcgcggtcctagtagttgatgctgcccagggcgtggaagcacaaacgttagccaacgtctatttagcaatcgatgatgatttggaaatcgttccggtaattaataaaattgatttgccggctgcagatcctaagcgagttcaagatgaaattgaaaacgtaattgggttagacgccagtgatgcagtgatggcgagtgctaagcaaggaatcggaattgaagaattactcgaacaaattgtcgaaaaggtcccggcaccggatggggatttggacgcaccgcttcaagcgctaatttttgattccaaatatgatgattaccgcggggtggtattaagcgtccgtttgtttgaagggatggttaagcctggcgacacaatcaagttaatgaacagcggggcaacctacgaagttaacgaagtgggagttaattccccaaacccgcttaaacgggaatatttaatggctggtgacgttggttacatcaccgccagcatcaaagatattaaggacactcgggttggtgatacagttacgttattaaataacccggctgcaaaaccattagaaggatatcgagaaatgaatccaatggtttattcggggctatatcctactgataacgctaagtataacgatttgcgggaggccctagaaaagctccagctcaacgatgctgccttagaatttgaaccagaatcttctcaagcattaggcttcgggttccggtgcggctttcttggattgttgcatatggacgtaattcaggagcgtcttgaacgcgaatttaatttagatttgattactacggcgccgtcagttacctaccgggtggaattaaccgatggtagcgagatttcggttgaaaacccttcggagatgccggatgcgtcgaacatcaagaatatcaaggaaccgtacgttaacgcggatatcatggtgcctaacgattacgtgggggccgtgatggaattggcccagtatcgtcggggaatctttaatacgatggattacattgacgagaatcgggtggacgttaagtatgaactaccattatccgaaattatttttgacttcttcgataaattgaagtcaagtacacacggttacgcttcattggattatgaactcggtgaatataaagtcagcaacctagttaaaattgacattttactcaatggcgatcgggttgatgctttaagttttatcgctcaccgagatttcgctcaacaacggggtaacgaaattacggctagccttaaggaaatcattccccggcggaactttgaaattccggtccaggcagcgattggaaataaaatcattgcccggactaacattcgtgcttatcgtaaggacgttacggctcgcatccatactggggacccagaccggcgtgctaagcttttagagaaacaaaaacggggtaaaaagcggatgaaatcggtcggaaaggttgaagtgccacaagaagccttcatgaccgttttgaagaccgatacggaaagtaaagggaagtaagcctaatttaagacaaaataaaacagcgaaagctagtaaactagttttcgctgtttttttatagttcgggattatgggcgaagtaaagcggggataagtcagttgacttggtaattaactccgcggtcaacgcttggtaagctttaatcgcaatattgctaatctccgtaccagcttggttaagcaacggtgttaattcttgacgatcaatctgggtagcctgcgtttcgtattcgtgtagcttgtttttcatagctacgttaaccttactttgggtgtcgttaagtgctttaataaactcttggtagtgcgcgtcagtaaggacgcttgccaatttgaagacccagtaggcggaatctgcagagtaaattttttctccatggtggtacatctccggagtgctgctcatcccagcaaagaatggcacatagacgctttgcgcagctacgcccatggccagccagtgaatcccgccgatttctatcgggaggtctggcttaatttgtaaaatgtgtgattcctgagttgccggcaggctaattggccggaattgatgcttttcagtttccgtacccgtgccgaccggattatatggggtcccttcataatgagaacttaagatttgttggacgtcctcaacttgaattaagcgactagcccgccgtataaacggaaggtcatggctagtaggactttgtttaatttccggatttaaaattcgttgtccttcccaaacccgtggggtgttgtaatactcatctgataaatcgttcaccccgaagatttcacggaagttgaaacttgctgggttggggttaaggtggtgttgggcaacgaactcacgaatgtcggccttaaacatgaagtgatccgggtcgtcaaaatcaatttcttggatcgacaactggttggccactactgcgtagcaatcgtcaggaatacgttgcgcaacccactgatggccgccagcggtttccatgtaccaaacttcatccgcatcggcaaataaaattccgttagtctcgttagtgccgttttcttcaataagtttagctaggtattgaaccccttcacgggcgctgtgcacgtaaggaagggtgaccgttaccatagcttcttctcccagcccatctttgacaagcggatcaaatcctaagacgcgttcgttagtgtaggcactttcggtagcactcatcgctacaccgtactcgttgattccatcttcttcaaagagcccaaattcggcagtccattctggagtggtggtatatttaccccggacttccggtagttccgtagtaaagccattgtcgtttgatttaaacgtgcgttcatccgcggtggaaacgtggtggggatgtaccacaaaatgctttggccaagctgatttagcgtcttcgttacgcgcaatcatcgttgaaccgtcggcagttgccaatttacccgctaagaaacttgtacaagctgaatatttttgagtaattgtcaaaaccttctttcgttatttcctttagtgtatcataagaaaccgatagcgatgagggcattgtttctaaaaagcaggccagcaaaatgtaagataaattgattttataattgttaaaaatactttgttttttaaagcaattcatgagattatagttgtggcaattttattaaaggagggatttaaaatgccgttaattcacattgatttaatcgaaggacgtagtgaagatcaactacgcggattggtaaaggacgttaccgcggcggtagtaaaaaatactggcgcacctgccgaacacgtgcacgttgttttgaacgaaatgcaaaagaaccgttattcagtagcgggagttttaaagagcgacgaaaaataggttgattaataaaaagcttcttcaaagaaacggaccggcacctgctggatggttgtttctgattgaagaagcttttttattagttagctagatcgagatattcggacaagtacttggcaatcccgtcatgctcattatcaaattcggtaatgtcgttagcaatcgatttgatttgggcggttgcattacgcatcgccactccgcgacccacgtagtcaagcatttcagcatcattatgctcgtcaccaaaggcaatgatgttttgccggtcaatgtggtagtatcttgctaagtaatcgaccgctttagctttttgaatccccttagagacgatttctaagacgctgtgcggaccgccccagaccccaacgttaatataatcgcggtaatgatataacagctgatttttaacaaactgggcgctgttaggttcaactaggatggtaatggaagtcgggttcccccgcaggctttcttcagttaaaacttggtcgtctgaaatctcatgcgggaagaaatcgaaggtagccggcgcggcgtgatcagcaaagaacgaatgcttattttcaactgccagtaacttaatgccgtaatcatccttatggcgcattaaatcataaactacggccttattgatggtcattgaatactcgccatcccatttttgatgaggaatgtgggtcaaggcaccgttaaaattggccatgggagtggttaattgtaactggtcgtaaatgtcgcgagccatccggtatggtcgtcccgtgacaattgaaactaaatgtccagcccgggtagccttttgcaaagttttaatggttaagggtgaaagctgactatgattatttaaagtggttccgtctaaatccagagtgattaatttttgttgcatttgatcgctcctttttaaaagtattattagcctattttaagccaagtgcttataaaatgaaaggtaccttaccaattcttaccgtccggtggtcgactttagtaaaattagttataatggattgcgagtttatttagtaaattaaattgagaagagagtggaatatgcgacttcctgatggtttcaaagaaaaatatcaaaaattactgggcgaagaggcacaaccttttttagcgagttttgaccagacagttgaaaagggcttccgagttaatccgttgaagggcacggtaaaattacatgaccattcaatcgaccagccaatttcatattctgactggggatattatgggaaggtcaacggtaaaacgattgaccaccaaagcgggttagtttacagccaagaacctagtgcgatgctggttggcgaaattgctcacccgcaaccaggccaaaaagttttggatctttgtgcggcccctggcggtaaaaccacgtatttagctagttttatggctcaggaaggacttttggttactaatgaaattaatcggggacgggctaaagtcctagctgaaaacgtggaacgtttcggaattcaaaatgccataattttaaacgagtcaccggatcggctggtaaaaaaatttaacggatattttgacttaatcgtagtagatgcgccgtgttctggagaaggcatgtttcgaaaagaccctgaagcggtcgaatactggtctttggaatacccagaagaatgtgcgcggcgacaacgtgaaatcctgaaaagtgccatgcaattgcttgctccgaatggtaatctggtttattcgacgtgcacgtttgcacctgaagaagatgaacaaatcattgcttggctattggaaaactatccagacttgaagatggaacccgttgcgcgaacggaaaatatggatgcagggcgtcctgagtgggccaacggcaatcctgaattagctaaggcaatccggttgtttccccatcattttaagggagaaggccattttattgccaagttaagtaatcacgcggaagctgcgacacctcagccaaaaggcaaacgtaaaaagaagggtcgggcaagcaataattcattagatcgggaacaacaacgattatggcaagattttgcaaaccagttcctcgtaaatccccaatcttttgcaaaggatcatttaattgtgcacaatcaacggctatattatcaaaccgttcccgtggatttgagtggcttacgaattgttaaaccaggacttgaactgggagaatttaagaagagacgatttgaacctagtttaggactgctgatggccttacaaaaagccgacattaaacaggtagtggaaatcacgccagagcagtggcaaaagtacgtgcatggcgaagaaattgctacggaagctgcgggcaagggatgggttgctttagcggttgacgatatcattgtcgggccgggaaagttagtccaaggtaaagttaagaacttttatccaaaggggttacggatgaattttgcggttaagtaaaaataaaataaaaagctggatcggcggtggaagcgtaatacgctcgttaccgtcatccagcttttatttatcttatcgtaattgccgctccgacaagtcggctaacttagtaaccccgagcaataccattaggcagcggagttggtacttccaacgctcaattaggtcgatgatttcttggtcgtcgtgatgtagtagttgatggaggaagtagccggcaacgcccacgttgtccgctcctaacgcaatacttttaattacgtcagcaggggtgcggataccaccagttgcggtaaccgatagtcctaattcgctaacttctttgagcgattcaacggtggtgagccccaaatcagttaaaaaggcgaaatctttttcggaacgccgcgcgttttcaatttggacgaagttagtaccacccttaccaccaacatcaatgtaccgaaccccgatggattgtagtcgcagagcgtccgctcgggtcatccccgctcctactgctttaacaactacggggacgctcacagctgcttgaatagttttaatttgttctaaatagttaaaactgcggtcgccttctggcataaccagttcttgcgcaacgttaatatgtaattgtaaaacgtctgcgtcaagcatggcgaccgcttttttggctgccgcaacgctagcgtccgcgcccaagttagctaaaatcagtccgtggggattttcatttcgaactacttggaaggtatcggctaattccggatactttaggcctactgactgagagcccaccgccattgccaaaccagtttcacgagcaatgatagctaatcgacgattaagtttcgcggtcgttgggctgccaccagtcatggcttggataaagaaggggacttctatgggaagtcctgctaatttagtttggaggctaacgtcatcaatccccatttctggtaaagcgttggggcgcaacttaatttccgtaaaacctgcagatgcgacgggctggtaaaatttttcagcgagtgagacgtgttcatctttacggtgggattgaatatttttcataagtactcctaactcaattcatcgatatcatggacatccaaatctaatggttgaatatcttctttttgccattcgttaataattttttcagtattatcattttcttcggtgattacaattccacaatctccgccaccagccccagaagattttgcagctccgccgaattgttcagcaatgtcgcataaactagttagcgcaggggtttcaatggaaacgtcgcttaataaacttaattgttgtaagagaagccggttggcggtaatttgttgcttaattaattggctgtcaccgtttttaaatccttcgatcattttgcgcaaacattccgcactgtttgccaagaactcgtggtaactgtcggtttcttgataactggtggtggcaacttggtcaactagatccgaagtagaagctggtgagccagtccaaccgattagtagttttaaatcggcgggaggagttaataattcaatctttaactcgggccaaggcgtccgtagaatcgttcctaaatctttagtgcgtcgcatactatttaaccattcgcggttgaaggagcggtatgcaatccatccgccataaacacttgcggcgatgtcgcctagcgaaccatttccctgaacgtctaaatgggcaattgaagctagcttaaaaagtaactttttggttagggggatttggtaaaatttggccaacgccttgatggtagcgacggtgacggctgctgaactacctaaaccatactttttaccatcgctgctatccaagtcactattgatgtagagattgtaagttcttagttgacggtgcattaaaaccgctaattcttcggtgatggagattgccgctagaatatagtggtaaggattatcacgattgtcaactaccaattggccgcctttacgacgccaggagaccacgttgtcatgatattgcttagagatgatgtttccaaaagttaactcgctaggttcaatactagcagtaataaattggttcaccgcaactaataccgcactgttacctggttcgacaattgcgtattcaccagcaacgtataattttcccggagctttttgtgttatcaatttaaaaatccctttcagttttttgagaatttaattccactgcctggacgggcaatgactaattggcgttcttcaaagtaatcctttaaaaagtttcgaatcgctaaaacgtctttgttttggcatagaaccttcacattcgggcccgcatcaatggtgtaataacattcgatgccgtgttcctttcgaagccgggtaacgagccggatgacttttaaggtatcgggctggaagtaggtaaatgccggaatggccgcaagggtggttgcgtgcatcatcattgcactgtgctccgctagctccccaattttggtaaagtcatttttcttgactgcggcaagcatttcggggaccatgcggttagattcagatacccacgtgggataaaagggagaagtttctaccgttcgttgcatcccgttagtgcttttaatactcttttgatgactattgactacgacagtaaccatgtttaaatcaatatctttttcattgaccacttgttcgacaaaggaagattcatgatcgctgccacggtgccaatgcacaattccaccgaagactgaacgcgaagcagaaccagagcccaaccgagcaattcgggaaatgttagttaggtcatgttcatcgcctaaagcatccgcagcggctccagccaaagcggccattccagaagcagacgaagcgagcccggctgaagtcggaacatgattaaaagaccgaatttttgcaaatccagggtaaccatactcttcttttacggcgtcaattacgcgattaattcgggccatatgtttataaggcattaaattgccatttaaccagaactcattgaccttgtaatcttcagagaagttaacgacagtatccgtataaaactcgtctaaggtcaacgatacgctatcattagcggggatgattaattcagaatcaacttttccccaatacttaattagcgcaatgttggtatgtgcgcgggcaaagccacgcttcttgtcggttgtcttcaaaactaaaatctactcctataatttttcaatccaagtggcagttgctccagctttgcgtaattgaacgctaacgttttctgccgcttgggcatcggggactaaggaaattacacagccgcctagcccgccaccggttaatttactgcctaaagcaccggattgattagccgcttggattaatttttcgactgccggatggctaactcctagctgacggagacaaacttgcgcgttattcataatgtcgcctaaagccaaagaatcatcatcctttagggcagttgcagtttgactagttaattctcccaatttttcaatcaaaagtctactatcattatcgatacgtagcttgtttttaacaatgtcaacggcttcgccagtctttcctttaattccggaatcactgattactaagtagccgttaaaattaattggcaaagctttaatggtcccatctcgtttaaaccaaattggtcggtctgcgctggcggtcgccgaatcaaggccgctagggttaccatggataattttttcggaaatattaaccgtttttaatagcttgtttttagttaagggacggtcaaaaaaggcgtacatagcgcgtacaattgctacggcagtggaagccgaagaacccatcccccgttcagctggaatttggctgtcaatatctaataacaatccataatgtggctttcctaacgtagttaaagtttggttaatcagctgcttgattcccaacaaattactatgaatatcatttaagaagccattaaaatagcgactccgtatttgaatgtcgccagggatggattgtatttttacggttgtttttacgttacggatgggaagggcaatcgcgggctgattatacaccgcactgtgttcacccattaaaataatttttgcgttactagttttaattacctctttcacgatgctcctcctttttggcctaaagtaaatgatactttaaatcagaggatttttcgatgtagagaaggtaaacatttggtaaaattagtaattagagactaaggttggagatttagtaatgaaaaaaacaaggtatgctgttgtagatttagaaacaaccggtacgggatcggttgaagaaagtcgaattattcaaattggctgtgcttttattgaaggcgaccaaattactgaaacttatcaaacaaaaattaacccgcagatgacgattcctaagcgaatttcacgattaacggggatcacggatcaacaagttcgccaggcccctaagtttgcagatgtggcggataaaatctatcaaaaattagcgggcacggtgttcgtagcgcacaacgtcaattttgattttccgttcttaaatcgagaattggtgcgtagcgggtacccagaattagacttaaaagcgattgataccgttacgttaagccaggttcttttttcgcgtacccgtggttatcggttacgggatttaactaattatttacacatcgaacacgacgacccgcactcggcagatagcgatgccgtggcaaccgcacatttattcttgaaaattaaagctgcgttaagtgaattgccaatcgttaccttagagcagttagttaaattaggtgaccaactacctttacaaaccgcaacgattttagaagcggcgttgcaaaaaagcaaacggcatcccaataagttaccggatgacttattagtggttgacggattggcaattaaacgacccgctcccttaaatacgggtgaagaggttaacgtaaaaaaagaagcttatccacagactaagcgaagcaaaataaaattgtacaacaagacgttaaagtggcgtaagagtcaagcaaccttaatgaactatgtttaccaacagtttagtcaagaaaacgaagaaagaaacatcgttgttgaagctcctacggggatgggcaaaacgttagggtacttgcttcctcttagttatgtggggcaacagcgcgcgcgtaaagtggtgattagcgtccctactaccgttttacagaaccaagttcttaaggtaggtaaggagcagctaaatccgcttttgagatacccccggcaatttgcggtgttaaagggtagcagcaattatttgaatttagatttgtttgccaagaaaattgccaccccaacggaactaagtaaggatggccggttgttggcaatgaaaattttagtttggataaccaccacagagactggtgatttcgatgaaattaattaccacgttggttttggcaatagtattgatcaatttcgccatgcgggggcaaccgtattatctgcacaatcgccgttttacagttatgatttttatcggcgcgctaaaaccaagctaaagtttgctgatttcattattactaaccatgcttacttggcgcatcacagtgcaaagtttaacatgcaggagcgggcgccgtacttagtgattgacgaagctcagcattttgcacaggaattagctaatttaaatcaacaatatctagacttaaacgaattgatgatggaagcgcatcggttagttagccgattattaatgaaccaccatgataacctaatgcgttcggtaatgaagcatccgttggctggttttcatattcgccggttcgttaatagcctagaaaaaatcaaccggctaatttcccaaattcaagggaatttgtatgaacattttgttcaacggcaaaaagtggaactggttgaaaatcaaccagctgaaattgcaatcgacgaagctactattcaacagctaaatcaaaacgagtttaatgcgctcacccaagaactcgctaacacctttattgaatttgacacgctggaccggtatttcaaacaacatgacttaggttcggtaaccaacgaagcctggcgacaaatctgggcgtttcaaggtaacctaactaagttttacgacgcaattcgcgacttgaaaaatgattccgcgcaaagttactactggattacgctaggccctaaccatgatgctggtagtatccgaattggccggggagtagttaatcctggagaattttaccaaaaagaaatcgtgccagcatttgctcaaattttgttgatcggtggtacactatttgttggtaatcatcgagattatttcttagacaagtacgccttaaccaaggaaaatgcaattattcgttcctttaatacgggggtaaactttgcaaaacaacttgactttgaagttttagattctagttttacgctggatccggacacctcgccgaaagcttacgagcgctttttggccaacgcaatcgtggaattaacggaagacgttaaccggcaaactttagtactttttaattcgttagataccattgagaaggtatatactaggatgatgcaggaacatcctgagcgctcccgtaaaatcttggctcagggcgtgcatggttctcgtgctaagattatccgagagtttaacgatgaggataacgcaatcctgttaggtgcggcgtcattttgggaggggattgactttcctggtgaccgtttagagtacctaattgtgacccggcttccatttcgttcgccaggcgataagctagttcaactagccgctaagcgggcacgaaatccgttccggcagtttacgttgccagacgcgttgttaactttcaagcagggcctaggacgggtaattcgcaatagcgatgataccggagcagtcgtgatgttagataatcggattatgaaacgtcgttacggcaagcaatttatccatcagctgcctaacggagtagaagcccactatggcaaaattgatgagattaaaacaagggtcgctgacttttttaagtagtcccgttgtttatgttagttgaggaagattatgaaaaaaggtagacttaaacatccatttttgctgataacttttattgtgcttgcaacaattattggttcagctgtgattatttttaatgagattaaccaacccattcggggggatacccgcgtagcaaaaacgattgcgctagacaatactgacttgaccaaagttgatcgggtaacgcgatttgtttataaccaaaccgagtacacagtttctggtgccaaaaaagacggcactaacatctttgtggtaattgctgatcacggaaagaagatcacagtataccctcaatcagcaggagtgtcggaacagaccgcaattaaaactgttgagcaagattctgcgttaaaagaaattacgtccagccgatttgggattgttaaaaaacgtccggtgtggatgatttcgtacattaaccagaaggaccatttagtcattaaactaattgactttaaaactggacaagaaatcaagcacgtatccacgtactaagttaaggagcaaatatgcaagacgtattgttgaagttattacaggacggcaacactagcattcctaattttttgttagataattatgcaaagttggggatgactaacaacgaatttttactatatttacaaattaagaaagaacaatcgcggggaaatgggttcccgccgatggataaacttgcaacgagtttaggcattgacagccaaaccctatttgcaaccatccaatctttacaagacaaaaagatgttggaaattaagcaaagacgggatggccagggtcagctaactgatttttatgattttagtttgttttaccaaaagttaattgccctcttagatggaaaggcgactcaagaggtggcaacgcaaacgcaagagaaaaccaatagcatttatgaccagattcaagtagaatttgggcgagcattgtcgccgatagagattgagacgattgcccaatgggttgatacggaccacttttcgccggaattaatccggttagctttaaaagaagcggttttaaatcaagcgtataacttgaaatatatggatcggattttattgaattggcaacaacgaaacctcaccacggcggctcaggtagaaaatagtctcaagcagcgcccgcatggtgaagcggaaaatagttccaaggtcaccaaaaataaagcctcaaatgtatatattccactaattaaacttactgataaccaagataataaataaatgtataaaaaatacctccttaacaaaggaggtattttttattatttaacgttcgttagttactggaactaaccgaggcgttctcggtagaaggcgaggtagcagaagaacttggtgtttcactgctagatggttcgctagagctaactgaactactggaagatgatgactcagaacttgaagagtcgtcatctttttgactttgttcgtcgtgatcgtcatccttatcctcatccgaagaagatgacttgctcgaactgctggagcttgaagaactgctaaagattgatgagtaggagcgtttattattttttgcataatcatcgctcttaccggtatcatcataatctgccccaatttgatagtattcattttcacctttcttaccaactgaagatggcatactccagtccgcgttagatgaatactgagccatgtaataaatcatgtatttccacaggtactgtgccaagttagtttgttcttgggttaaataaccagtggtggagttaggatgatcaaatccggtccaaacagaaagtgagtagtcttttgtataacccgtcatccaggaatcactagaagcgttacttggaatgtcatatgcttcagtagctttcttagagtacgctacggtaccagttttacttgccatgttaattcctggaaggttagctgcacgtccggaaccattactatctgtagtaacgccctttaaaattgaagtcatcaggaaggcggttgctttagacatcgctcggctacctttagacttgtatttgtaaatcttaccatcattagtaactactttatgaatataggttggtttgtggtaaattcctccgtttgcaaatgctgcgtatgcggccgcttcttgcaaagtagaaatatataaaccgatcccgttgctaagggtgtacccatctttactggtaattcctaagccttccataaagtcgcttgccttagaaatgcccacatcttgtaaggtgcgaatagccggaacgttccgtgattggatcaacgcatcccgaacggtcatcgttcccttaaactggtggtcaaaatcgtaaagcttagtgtttgttcccggataagtaaacggaatatccttaactttacgataagttggccacttcaagtattcaaaggcggggccgtaatccatcaaaggtttagcagtggagccggaactacggtcagtttgtaccgcacggtttaaaccataggtgacgtcgccggttttccgaccacctagcattgcgacaattttaccatttttgttatcaaccatggtggcgccgacttgaatttcgtcgtcattaaagttaacggtttgatcatcgtttgctagttcatacaatttcttttgagcagcgtaatccatgttggtataaactttcaaaccgcccttggtagtatcaaatcccttatctttaaggtcggttaatacttctttaacgtacgggtcaataatcttgtttttcttggtagattctgaagtagtttcgtgtgtatcagttaacccagattgaatactttcattttctgcttgatctgcttgttgtcgagagatttccttattcttaaccatcgcttctagaacggtatctcgacgtgacttagcatatttagggttgctaattggatcatagttagtaggggactgtggcattccggccaacaacgctaactgagctaaagcaagcttgtccagcgatttaccaaagtagtatttagcggcagtttccatgccatatacgccgtttcccatgtataccttgttaatgtagaattctaaaatttgatccttgctgtactttttgtcaacttgcaaagctaaccaagcttcctgagctttaacctttaaggtacggtcggaagcatccgttgagaaaacggatagttttactaattgttgggtaagggtactagccccttgtagtcccagggaagagccggtaaagttggctaatgcggccccaacgattcgtacggggtcgatcccattatttttatagaagcgccggtcttcaatggaaacaatcgcgtgttttaaagtcttcgggatttcttcttttttaacatattcccggttctgcgaccctagacgggttaacaccttaccgtctttatcgtaaataacggtggcattgtcgctagataattgcgcttccgtaatcttgggcgcgctttgggcgtaatacataaataaaccgccgccaaaaacaattaacgcaactaaaaagccaaccgccgctaataagagctttttaacccatgaagaaggacctctcttattagtatgagaacgttgcatttgcgaatgttgcgttcgccgcaggggctgttcatgattatcatttctactattcatatctaatctccttgctctttaaaaatcgattcactatataatttgatctactgcctcaagatatggaattaacgggttaatctggtagttaatttcataaccattttgttcaaatacagaaagcggaatcgattttcgaccaccatttttgatatttttccaaaatttgaataagtctgttgccggtagtaaaaatatcttatccaattttacaaattttactatggtaaagcaaactccaccaactttttggcattgctccatatgggtaatttgatgttcgtgaaagttacttaatggaaaagaagtcgtattcgtagtttcctttgcatcaaaatcaatgtatttacccttgtatacgccgttatagtcagtagtggaagctttactaaaatatgcttctttaattcgtgctgcactacgtttagggtagtcaacctttacaatttgaattggggttggctttttatgcactacggcaattccacgagataagtagtaacgattactttcgttaagctcttcttctaaagacattccccgttttccgtaaatcggcacgctctgtttctgtggacgatcaacactagggtggttattaagtgttgatccagttgggtagttaaatttcacggctcatcctcctgatagcttattatactatgctaataagctctttaagattacaaaagacttaaaaaataggggaaccacaaaacaatttagtttttctgcgtacctataatgtagtaaacttcatttacagatggtatgaaatgggagcgataaaatgagtcggctttggttaacaggttatcgtagttatgaattagggattttttcggatagtgatcccaaattaaaggtgattaagtttgctttaaaaaatcggttgattgaaaaaattgaaacgggaacgacttgggtgattgcgggaccgcaattaggaactgaacaatggggattgatggtagcaaatgaactaaaaaaagactatcccgagctacaaacagcaatgatggcaccgttcgcggattttggtcagcaatggaagtcagaaaaacaagagcaattggccgctcttaaagcaaaggtagatttttacggtcaggtaagtgatttgccatacaaaaatccacaacaattaaaaaattatcaaagttttatgttagaacataccgacgaagcacttttgttatatgatagtgagcgggaaggaaaaaccaaatatgacttaatggcaattcaaagatatcaaaaccaaaatgcgtacgaccttaccaccatcgatttttatgatttagaagatgaagctaatgcatacgcagaaaaccaggaataattctttgaatttccaagaagttttgatacaatagaatacagttatttgatcaatagtaatcaacgaggtgcagcgatggacaacattaattttactccaaaggatattttgcaaaaagaattcaaaccgaagatgcggggttatgacccagcagatgtcgatactttcttagattccgtaattaaagattacgaaaactttgggaaagaaatcgaacggcttaaagacgaaaatgaacggttatcagataaggttgacgaattaggtaagcaagtttccgctggtgcaaccgttgaagaatcagcacccgttagtggagcaactaatgtggatgtcttgaaacgtttatccaatcttgaacgtcgcgtatttggtgctcaacttgaagataacggcaacgattcgcatcgaatctaaattaaatatcattttgtaaatctcgggtaattgcggctaacatcggttagctgaggaaagtccatgctcgcacaagctgcgatgcttgtagtgttcgtgcccggtgaaaaaataagctggggcatctgatttcagatgacggcaagccaacgagctaaagcttcggccatgctctagtagctttgaaaagtgccacagagacgatcttattaagaaattaataagttggaacgcggtaaacccctcgagcgggaaacccaaactatggtaggggagcttcacatcgtggaaatgaactaagatgtgggggcagatttaaaatctgcagatagatgattacccaaatttaaatttttcctgagaatttattttggacaaaacatggcttatagaggtttacaaattcagggaggctagggtgaaagtttacttttatcctagccttttattttactaataaacaattctaattagggaagttattatgaaaaattacaaattattagcaaccatggcaagtggtttagaaagtttgactaaaaacgaattaaaagatttaggttatgatgtccaaacagaaaatgggcgagtaaggtttgaaggaacttttgaagacattattcgcactaatttatggttgcggactgctgaccgaatcaaaattattgtgggagagtttaaagcggtcacttttgacgagcttttcgaacaggttaaagcattaccgtgggacgagttaatcccgattaacggtgcttttccagtaaatggtaagtctaaaaaatcccaattacatagtgtgcctgacgtccaggcgattaccaaaaaggcaattgttgaaaaacttcgcgaagtttaccactggcgcaatcaactaccggaaaccggggctaagtatgggttagaagtcagcattgataaagatcacgtattaattacgctggatactaccggagatagtttgtttaagcgggggtatcgtttgtataaaggatctgcccctcttaaagaaaccatggctgcggcattagtaatgctaactaattggcacgctgataaaccactagtagacccattttgcgggtcaggaacgatcccaattgaagcagccctgattggacaaaatatcgcccctggctttaaccgtagctttgcttgtgaaagctgggaaatggctgacaaggaattagtggaacggatccgggccgaagcagacgaaaaagccgattacgatgtcgaactcgacattaccggttatgatattgacggtaaaatggttgagatagcaaataaaaatgctgaagaagctggattagccggaatcattaattttaaacaacaagccgttaaggactttaaaacggagcaaaaaaatggggtaatgattggaaatccaccatatggccaacggttaagcgaccaaaaagcagcccgcgaaatttatcgtcaattaggtacggtaactaagcccctagtcacttggagtaaatatttcatcactagcgacctcgattttgaaaaatactacgggcaatcagccactaaaaaacgtaaattatataacggagcgttacgaacggattattttcaattttggggtaaacgcgaaaggtaggtcttactggtgaaaattgcggtaattggtaacgggattgtaggagctacgtttgttagcgaaatgctagagcgtttcccggaaaatcaaattgttcaatttgatggcattaaaggaacggcaactaccgcttctgctggaattatagctccctggttatcaaaacgaagaaatcaaaaatggtatcacttggctcgattaggtgccgaatatttaaatcagctcgcccaaaaatacgaaatgccagctgacgtttattatcagagcggcgtcatttatactagagaccaagctgataagttaagtgagttgtaccaactagcccagacgcggattaaacaagcgcctcaaatgggagaatttgaaattgtcgaccatcagacaattcaaaaggaatttaattttatccaaaccaaaaatgacggacttttcgtaaagggcggcgctcgaattgatgggcgccagttcattaattttttacaaaagcgtaatcaaagtaaatttgagtttcgccatgacgttgcccaattgaaacgagaaggttcgcacgtgctcgttaatggcgaacattttgatttggttattttggcttgtggggcatggttaaaacaaactttggcaccacttggggtggaagccttgattcggccacaaaaagggcagttaattgaagttacgctacctgagcacgcacggatggctgacaaggcacccgttctaatgccagaaggtgaacgagattttattcccactaatcaaggaaccttgctgattggggctacacacgaaaatgatcaaggttttgatttacaagttagctcccaaattgtggaggacttattagcgagcggtcaacgagtaatccccgggcttactcaagcaatggttaaaagtgttcgcgtaggtacccgagcatatacagcagatttcgccccattttttggttatttacctgaatttccagaaattatggttgcatccggtctaggatcttctggattaactacgggaccaatcattgggaagttactagtagacttagttgcggatcctcagcgcgacgttacctctttgactaagccagtcggtgattacgttaaattaggaggaatctaatgaaaaaagtagagagtttttattatcaacctgattttttaaacaacatcatttcatggtgttggacattcttgattttaatcgtcggggtcattttttggctggaagttaccacgtttaattggattacggcagttttccttgcactgtttgtaatggtaattagtattcaaacggtaagccgaagggtcgaagtaattggctcggaagttattatcaatcgggtgtttaaaagcaattttaccgtgctaagcatcgctaatatcgaagacgttactcgcggaaaagtctcgataagtttccaatatgatcataaaagatataaactattgatgaggcgtcgctctgtaaatcgcctttatgaaattcttacaaaggagtagatcattatgaacgatattgagatttcccaaaatgcagaaatgctacccattcaagaaattgcccagcaggcgggatttaatgaaaaaaccgtcgaaccatatgggcgttacaaggcaaagattgatatttttgctgaagacgaagaagctgctcaattaggtaaactagttttagttacttcaattaatcctaccccggctggagagggtaagtcgacggtcacggtggggcttggcgacgctttaaatgaaatgactggttctgcaatggtggcgctaagagagccttcacaaggccctgtaatgggcatgaagggcggtgctactggtggaggctattcacaagtagtcccaatggatgaaattaacttgcattttaccggcgatatgcacgcattgaccgctgctaataatacattggcagccttgattgataaccatattcagcagggaaatcaactcaatatcgatccgcgaaccattgtttggcggcggtgcttagatattaacgatcgggctcttcgaaacatcgtgattggcatgggcggccgctttagtggggtgccgcgagaagatcactttgacatcaccgttgcaagtgaattaatggcgattttgtgtttggcagaaagcttgacggaccttaaaaagcggattaaccgaattttaattgctaaaaattatgctggagaaccaatttttgtccgtgatctaaaggtcggcggtgcgattaccgccctcttaaaagatgctttaaagcctaaccttgtccaaacattaggtcatactccagcattaattcatggtggtccatttgctaatattgcacatggctgtaacagtgttttagcaactaaaacggcgctaaaacacgctgactacacaattacggaagccggttttggagcagacttgggtgctgaaaaatttttggacattaagactcccgttttaggtaaagaacctgacgcgatcgtcattgtggctaccgtacgggcgttggagtacaacggaggcgctaagctagcagacttacaaaacgaagaccttgtcgccttggaaaagggttttgcaaacttacaaagacacattaaaaatatgcaacgttaccaagtgccagtagtggtttcgataaaccatttcacttctgacactgatcaagaaattgccaaactcaagcaattagtagaacaggctggcgtacaagcagtagttactgatgcttgggcgaagggcggtgctggctgtaaagagttggcccaggccgtgattacagctaccgacacaaattcagatgttacgatgcaaccgttgtatgatgtggcagctcctattcaagataaagttaaagcgattgtgcaaaaaatgtacgggggcgctgaagttcaatattcagcaacggctttgaagaaaattaaagaatgtgagcaaaatggttgggataaattgccaatttgcatggctaagacccaatattccttcaccgacgaccctaagcaattaggggcaccgacaggattcactatgcacgttaatgacattaacattcgcttaggggctggattcttagttgtactaactggcaaagtattaaccatgcctggactacctaagcaaccggctgcattaaatattgacgttaatgataaaggagaaatcactggattattttagtgattagaagttatgaaatacactgcttatatttttgggctaattctattaatagctgatcaagcatttaaattttttattagccacacgattcccttaggtgcagtacggccattaattccaggtgcactgtcgttaactaatttacgtaatgacggggcagcctggagtattttggcaggaagccaacttttatttactctaatcacaatcgttgcgctctttgttttgggctatttattaattacgcagcataaccacgtttggtatcgttggggcttgagcctaatgattagtggcacgctgggtaattttattgaccgcattcggttaaagtacgtggtggatatgtttcaagtggattggtttaattttccaatctttaacattgccgatagttgcttaaccatcggagtgctcattttaatgattgcgattatgcgagataaccgaattgaaggataaggggattttatgaaagaaattaattttacgattgaagaatctgcaaagggtcgtttggataaggtgattgcggaaaatgtcgctgatctaacccgttctcaagtacaaagcttgattaaaaaagggcagattctggtaaacgacgcgcctactaccaatcgttatcaagttaaaccgaacgatcaagttataattaagctaccagatccggtagcaattgacgttcagcccgaaaaaatggatttagatattgtatatgaagatgacgacgtgattgtcgttaataagccccagggtatggttgtccatcctgctcccgggcacgatcatggaactttggtgaacggactattggcccacacgcctttggcaacgattaatggggagttgcgccctggaattgtgcatcgaattgacaaggacacttccggattgcttatggttgctaaaaacgaccaagctttagtaagcttgagcaaacagttaaaggacaaaactaaccaacgtaagtattgggcaatcgttcatggtaatatcaaagaagatactggtacgattaatgcaccaattggtcgttctaaaaaagatcgcaaaaaaatggccattaacgaggaaggccgtccggcggtcacacattttaaagttttagaacggtttggcgaatataccctcatagaatgccagttagaaaccggacgaacccatcaaattcgggtgcaccttaagtacattggtcatcccgtagcgggagatccgttatacggtccccgaaagaccttgaagggaaacggccagtttttacatgctaaattactaggatttaaacacccgcggactggcgaagaaatggtgtttgaagttgatccaccaactattttccaggccactttaaaaaaattacgagccattagtggctaagaaatttttgcacaaggttgaaaaagatttagataacgtaagtatggcgttgatattaaaactacggaggagctgacattatggaaaaagaaattatggatgcaatggcgatgaaacgggcgttgactcgcattacatatgaaatcatcgaacggaataagggcgttgaagatattgttttaattggcattaaaactcggggagtgtacattgctaaacgaatcgctgaacgtctaaaacaattagagaatattgatattccagttggcgagttagatattgcagagtatcgcgacgaccaacgtgatggggcaggtaagcggcctaccaaaactaatgctaacctatctaaaattgacttgaaagacaagaaggttatcttgatcgacgacgtattgtatactgggagaacgattcgggcggcaatggatgccattatggacattaaccggccagcgcaaatcagtttagctgttttggtcgaccgcggacaccgtgaattaccaattcgagcagatttcgtcgggaaaaacattcctactgcccagaatgaaaaaataaacgtcttcgttcgtgaaatcgacgatgaagacgtagtgttattaacgaattaaaggtgcactaaattgtggaggtggcattatggcagaccgttacttgattttagaagatggttctgtttttaaaggcaaagcatttggctcacgagcaaccacctttggcgaagttgtttttaataccgtaatgaccggctatcagcaggtgattactaatcaaatttaccataatcaaattattgttttttctcaaccaaccattggtgcggtcggtattgaccgctcgagttatgaatctgttgacccaacttgtaaaggagtgattgtccgtgatgtcgccgacgtttccattaaccggcgtcggcgcctttcgctggacgaatatttaaagcgacaaaacattccaggaatttctggaattgatacccgtgcattaattaagaaactacgcaccaacggtaaaatgaagggaagcattatcgatccggttaaggatttagaacatgcatttgaccaactccgggcgattgtcttgactaatcaacaggtaaaccaagtctcaacccctaaaccattccctaatccgggaaatggtaaaaatgtcgtggtaattgatttaggactaaaatatggtatcttgcggcaattaaatcaacgagattgcaacgttacggttttaacttattcagcaactgccgatactatttttagtcttgatccggatggtgtgattatttccacgggtcccgggaatcccaatgatttaccggcggaagttatcgaaatgattcaaaccgtacagcgtaataatattcctttatttgcgattgggttggggcatgaagcatttgcaattgcaaatggttgccaaattagtgaactaacctctgagcatcacggcgctaatcatccaattttatcggtaattaccgacgaaataatgtacgcatcacatggtcagggatacacggtagacccagcaaccgtgaaccgcaaggatttaattgttacgcattatgatatgattgatcactcaattcaaggtttacggcaccgggacttccccgcatttagcgtccaatttttccctgatagttcaccaggacctcgcgaagcaaccgaaatgtttgatgaatttatggaaatgatgacgacaagagggggccgttaagttggctagatttcacgcaagaaacgttttaattattggtaacggaccaacgcaaattggtcgcgatacggaaagcgaagcagcagccgcacaaattgttgagatttttgcgcaaaaggggcgtaatttattttacgtaaccaacgatgctaactccgtaatcccgcaactagacgtgccaattaactttatcgtcaccgaattaacggtgaacaatttaatccagattcttcgagaacatgaaatcgacgtaatcttgccggtagtaggtaatactggcgggctacagttagcggagcagttaaatgagtctgggatcctaaaagagcttaatattcggacaatgggcgtcacgaccactacgatccacaacatcaataatcctgaattgatgaataaagtcctgcgacatattaaggaaccaattattccgacgacggtagtggaaaacgaaaaaaacgcggttatgtttgctaagcgagtagggtttccggtattaatcaaaccgattgcttccctaactaagacaaaccgaattaaatgcgataacgaacaccagttacaagaagtgttagagacggccttcaaggtctcgacaactaaccaagttgccgtagaaaagagcgtagtgggttataaagagattgaaatgaccgtgattagagacgcagaaggttcgaagctacttattaatggtgccgaagaccttaacccaatcggtgttcattcgggtgattcgattatctttagtccaacgcaaacgttgaccgatacagaatttcaagaattgcgagcttcggcattaaaaattaccgaagttttgaaaattaagggcgtttgtcatgtccaatacgcacttgacccgacgaacggcaagtacttcgtaacacgaatcaatccgttctttgaccggactacggcttttgcagcgcgagcaactggctatcctgttgctacagtagtggccgagatcttattaggaaagaaccttcgcgaaattgagctaaccggagtgcaaaaacacgacgccttggcattaattgagcctacgttagatcatattgcggtacgctttccgacatggtcgtttgctagctttaagaatgcggatcaagagttaaatacgaaaatgaaatcaacgggagcagtaatgtctttcggacggagcgcggaagaagctcttcaaaaggcgattcgctcagtagattcaacgacagctgcggaacaagcggccctggacgaatcccaattgagcgaggcgcaactgattaacgtcttgatccacgagcgggcgggcgaagtttactatttactagaggctttacgacgaggttatacagttgacgagcttgctgaaatgacgcacattgacgctttttatttctacaaattacggcatttaattaaagttgaaaaccgtctaaaagcccaccattttgatgccgaggctttgcgagaagcgaaatactttggctttggagacacacaaattgcccacctctggcgtaccactcctagtgcagtacgcaaatttcggacggaaacggcgaaagtatttccgacctacaaaggcgttgagcctaccgctggggagtttccgtacctcaccaacacctattattcaacttttgaagatgaagacgaggctgtgcagatctccggtaaaaaggtgttagttttaggcacggcaaacagccaggtgggaacgaatagtgctgcagagtataccacttttcaaaccttacggcggtgtaaggctttagggtacaaagtgattttgattaataataaccctaacgcaattacttttaaccagcaattagcggacaaagtctatttagaacccttaaccgtggaaaattgtttgaatattatccaacgtgaaaagcctgataaagtactggctcaagggaaatggcaaattgttacacagttaaccgaacaaaacattgaaatcgcgcaaatccctctaagccgaacaacgcggtcagaaaacatcggagctgattacatggcggtaattagtaagataaatggtcaaacccatctatttggcattatcggggtggatcagaatagactgtttagttttgctgagaactcagtcgtggatcagcagttagacacctcggcaattgatgaagaagctaatcaaattgaacatgacggaatcttttcggtaatgttgaaaaaagaagcttccgcgttgaaggtgattagttgtgtaccggtggcgatccaggatttaccattcttatcccttgcatttaaccaagattttgcaggaatgattactgaaattacgcttaccggaacgtaccaaattgaagaacacccggtccggatggctaggtatcattacgaacatgtttatccgtataagcaatttgggttaacgcaaccacaaaaggcgccatactccttagcaattggtgccaaactagaacaagctgactcatagttttaagattagagcataaaaaaactgtcattataaagtcaattatgaatacacctgagaacttaacttctaagtgtgttccgttatccgacttagtatgacagtttttttgaattagttagttattttttctgcatcaatttttgaacgaccgtaatctgtggggtaacttttaaagtacgttgcccttcgtaaatcacaaatcccggtttagcaccattcggtttacggatattctttactggtacgtaatcaacaggtacgttagctgaattctttccctttgaataatatgctgcaattgtagctgcttcaatcagagtttgttctgacggctggctactttctacgataacgtgtgaaccaggaatatccttagcatgtagccaatagtaatcttttttagcggtcttcagtgttaaacgatcgttttgggcatcgttttttcccaccaaaataggggtttgatcgttggaaataaactgctccggcttactaataacgtttttgacacgttttttaggattcctttgcttacgaaggtaaccttcattttccaactcgattttaatttcggccaaatcttctggtttagccaaatcaatttgagtttcaatattgtccagaaaagcaatttcactttcggtatgcgcaatctgttcgctaacgtacttgacggcatttttttccttttggtactttttaaaatacttttgtgcgttctgcgacggtgataattggtttgatagtttgattgtgattggttgattctgatcataaaagtttggtaattcaacggaggtcatcccacgcttaatctggcttaaataggtagttaatacctctcctttaatccggtagctatcagcgtactgggtttgggccattgtattttgcaatttttttagtttttttcgatttttctttaattcattacgcactacccgaattaattgatgtccccgttgctgaacccgatcccgttggactttctcaaaataatattgatccagcatttcagaaaggctattaaaggtttgcaaatttggttgatccgcagttaacgtaggctggattgctgaataggttaactttttagcttgagactcgtaaataaatccttttgggctcgcattgaagcaatctaaaaactcgtggacaaccgttgcgggagtttgtccattaattaagcgataagctaattcaagggcattttctttgccaaaaccttgaaatgtggcttgaatttgcttagctaaaacttcataatttgggtaatcccgaagcaaattgtcccaggtttgctggttagagtcagtaaaggggttcaataattcttgagcgggtggggtaatgtattgtgcacccggaactaacatccgatatcggttttgatcagcagaaatgtgtttgatcgtatcgataattttttgcgaactgcctaagtacaaaataacgttactacgccgacccataatctcaactgataggattacgtcttcttcgtcaccaatatcattgcggtgtgaaaaatagaagttaataatacggtcattattcagttgcttaaccgactttaaaatagcgccctcaaggtgtttccgtaagctcattacaaaattgctaggagtagcggggttggatagggcttggttagtaacttgaacacgtgcataattagggtgcgaagaaattagtaaaggaacgtttttccgatttgctcggatagtgagtactaattcactttggtaaggttggtaaattttagctacgcggccactttcaagactgcgtaactcgttaaccatggcgtgggtaactaaaccatcaaaggccatgtaatcagtcccttctaataattaattactaatttcaagtataccgtttatagattttagttgcaaagaattgcttatttgcattatacaactaatttggttgtataatgcaatacgaaggagaggatcatttatgcaagccagtttaactgccttagagcaaattgctcatattcgtaataactacttaaaaaaatattgtcatgaaatggcggggaccgttgcagattggaagatggtgaattacgttaacgatgccagactaacgaccttaaatttagtggaactcagcggcttagataaatcaaccgttagtcgccaattaaaacatgctatccagcataattttttgcaaaaacaaagtaatgaaatcgaccaacgtaaaagtacttttacgattaccgataaaggcgataccttaagaacttacgttaaccaaaaaatggctgagtttgaccggcatctgtttgataactggagtgaagaggaatccgccatgtttcaaatcttaattaatcgcgtattaaaaaacgctttaaaatagggctgtcgtgtcaagttatgggagcattcaataaagaattatggtatagtgattgttatggattttaaatgaagtaggtgtactaatgaaaacagctattgttactgatagtacttgttatttaacggataaagaaattgaagaaaataatatcacggttgttccaattccagtaattatcgacggaaaaagttataaagaaggcgttgatattactaccgaagaattctacgaacgcctgcgtacgtcgcaatcatttcctagcacatcacagcctccactaggagaaatgattgaactttaccaagatttagctaaacagggttatgaaaatatcatcagtatccacttagctagtacgatttcaggtttagtggcgagcttaaagagtctagaagggaccattgacggagttaatctagtagtttatgattctcaactaacgattcgtttaatgggagtacttgcgcttgaagctgcgcgtatggcaaaagaagatgccgatatcaacgacatcattgcgcgactcgactttttacgttcgacatttgacgagtattttgttgtggatgatctacaaaaccttgtccgcgggggccgtctatctaacgcttctgctttcgtgggaagcttattaaagattaagccgattttaactttcaacgataagcacgaaattgtcgctttcgaaaaggttcggtcgcgtaaaaaggcaatggcacgggttgaaaaactctttgcggaggcctacaaatcagtagattatcctctgcgagccgtagtcattcatgccaatgatgaaaagagcgcgattaaatggctggagagcctaaaagaaaagtatcctagcttaccaattgatatatcttactttggtcccgtaatcggaacccatttaggtgagaaagcaattgctttggcttggttaattgattacacaaaaaaataaacgaattacagttggctgccaagagctgccagaagtaatccgcctagtaaactcgcgagtgcgtaaagcaccgcgagtttttttgtatttggttgtttgaatagggtgactacctcatttgcaaacgtcgagaaggttgaaaaacctccaaggacaccgctagttagcaaaatttgggtaagggggctggtaattacgctagttaaataaccaatcaaaaaacaagctagcatgttaattaaaaatgttgaccaagggaaactttcagaaagggcctgccgattaatgaaagtggttgcccaaaaacgaaaaagggcgcctagagcacttccaaggctcacaattaataaactcattactcccattcctttcgataatgatgcaaaatctgtttgccgccaatttggcccgcataggcgcaaagtactcccagaagaagggaaagtatcataaagctaccaccgttaatccattgcaaatgtaccagcaatttatctgaggatagaataaatgttgaaaaggtagtaaagccgcccattaatcccgtcgtaagccccacgttaataaaatcagaagtttctaaagcagttaataggccccctgttagaatacctagaagaaaagaccccaggaggttaatgattattaaatcaaatggaaaagcagtggcaccgtgatggaaaaatgactgtaatagcagtcgcaaagcaccgccaattgctccaaacagagcaacactaacactttttttaaacaaattaattcaatccctttcaattgaaaataagcaacattaaataaagtatcataaaataagcgttcatcatagcaggaaagtaagatttcagtatgattacaattaagccctagtgtcaacctcaaaggttcaactatgctaaactactttagtaagcttaaatttaaaggggttactttgcatgtcaacaattgaatttcttcatagtattgtgtggattttggtcggaatgatttgcgcgtatggattaacaattgaccagtttcaacaaacattaatcgcgcagtacagttcacgggtattatatatatttgttattcttacgggactgtttaatgtagttcacacagttgccatgtcgccattattagtttggatacagtttattttagaaattattaccatcggattatttgactttttgctgacgtacaaacgcaataaacggggctttaaaagcaattttgtgatcctgctcatctttgcatttgcaattacatcgctacttgcggtagtggttcagtatttttatggctagtcggactgtaaaagatgagaatcttataaaaataccttgttgtgttgacttttagtagagccaaaacgtgtgccaaaaggcagttcgttccgcttaactagaaattgaccattatgccaaattcaagcataatggtcaatttttagttaatgctcacaagctacctaacttttaaatttagttttaacgaatgattaggtcggattcaatggcaatttgacgaacgtccccagagattgctaaacgtcccgcagcttgtcctaattgacgaagatggtggtcaatagtgggaatttttaataatttccctgatatttgattttcttggcccatcattttcggtaatttcaattgattatctatgtaatactggtagactccagcaatcacgtcatcgatgttgccaaagataaaatctgggtggatttgagcgatccgggaagcagcttggtaagcaactggatgactatcaactccctcaaaaatcaactggtcgtctggaaaagtttcgaaaacgtctcgataggcttgcaaagttaccttactagttgcactaagttggtagggccggcttaaagtaatggcaatcttagaataccggttttttttaatccaattaaaagcagccacgtaagtcttttttcgtaacacatacgccgctgcaattggcgtaatcccggggtcttcacagcagattaccggaccgtatttttgataggcagctaaacgtgccaatggtagcttgtgtgaagtgaaaatgagcgcatcaaaagctttgcgatgcaatttttctaagtatttttcttccagttgctcatcgtaacgcgattctagcacagaaacgtgatagtccgcagcaaaggcggtatccataattccgttaattaattcagtaaagaacgggtgctgcatttgtgggattacgataccgatcgtattagatttacccttacttaaatcgcgagcaagcgcgttgggtacgtaatctagctcgtcgatgacttgttggatagcttgcttcgccgattgggatacgtaaccagtctgattgagaaagcgggaaacggtggatgccgaatacccagattttttagcaatgtctctaatgttggtcatgtaatccatctcctaatcctgataagtctattttaatatatgaaacgcgtttcataacaaattaggtaaaagggaacccgttccagttggtaaaataaagtattgcacttgatatgaaaccgatttccccctttaaactccaaggtaaagggggagatttatatgtatacgtattttgaagtaatcgctggtagtcatagtcaaatgtattatgctaaccttaaatgccataatggatatttggttatttccagcactagtaagtttaattgttcaataaagctcagcgatattatttacgtaacccaaagtgattttctaggtactaaagtatattcctttaattaccagggcacgcagctgaaatttttcgaaaatgggctagggatcggcgaatatttacgaaaccaatttaaagatgtcttagttaagctttaaagttaatacgcttaaaaggctacaaaatgtatcctgacaattgtttttttgttcaaaaaaacttatcatcattttaggtacatcaatgtgcaatttgaatgaaaggtgatgagatgactatgaacaaaaaatttaagttcaaaatgccatccgcgtataccgttttagtatttattatcattatgatcggtattttaacgtggttcattccaagcggtcactacgcaatggacaaagcggggcggattattgctggaacttaccagcagacgggatatcgtccccaaggcatttgggatatttgtatggccccaatcattggaatgatcgggaacaagtacacggacggtgccatttcaatttccttattcatcctggtaattgggggatttttaggagttgttaataaaaccgaagccttagataaggggattaatcaaatcgtctacaagctacaagggcgtgaaaaagcactcattattattttaatgatcttattttcccttgggggcacaacttttggaatgggggaagaaaccattgcgttttatcccttactaattccagtaatgatgaaagtaggctttgattcccttactgcagttgggattgcgttaattggtacgcaaattggatgcttagcttccacggttaatccgtttgctaccggagttgcttcccaaacgattaatatctcgatgggagacggattattttctcggattctcttgctagttctattcgacgtgattagtattacgttcgtttatcgctatgctactaagattaaaaaggatcctactaaatctctggtttatggtcaacgcgaggccgatcagaagcgctttttacaaggatttgatgagaatcaggctgctgagactgaaaagttaaccaaggcgcaaaaacgggtgcttttcatcttctgtttaactttcgtactcatgattattgctttgattccgtggagttcaattaacccaaactttactttttgggaccagtcggttaagtggctaactggaattccgttccttggcaagttacttggaacggatattgtaccgtttggtagctggtactttaatgaaattaccatgcttttcatcgtaatgtcggttgtgattatgtttgtaacccacatgaaggaaagtgaatttattgaagcctttatgaatggaatgagcgagctattaagcgtagcaatcattgtcgccgttgctcggggaatccaagtaattatgaatgatgctgcaattacagataccgttcttcactggggtgaaatggggctcaagtcgttaccaaagactgttttcattatcttgacgtacttgttctacattccaatgtcgttcctaatcccatctacttctggattagcatcggcaacaatgggaatcttaggtccaatggcgaactttgctcacgttgcagaaagcaccgtagtgactgcatttcaagctgcttcaggctgggtaaatttgattacgccaacctctggaatcgtggtcggtgcgttaggaattgcgcatgttaacattaccgtttggtggaaatggatggctaaattgatggtcgttttattgattgccacgtgcgtatatttagcagtacttgcaattatctaaagttatcctaattaaataaaaacacgtactttgtcagcgcattaaattcaacgctgtaagtgcgtgcttttttatatgcggcataaaaatcattgtatagcataagaaaatacatagctgaacttaaatgccagtttaaccgttgcagatagcttagcttggtacaaataaagaatgcaaagctatctgatctgggacaagtcaaatgtctacgaatcctggtgaaaggaagagtggggaccagtaaagtgcagatgaattgctactgaattagttttctttttctagtttacataatatatattattgaaagtaacgtacaaatttaataatggtctgattttataagtaatctaaaaaatccatgattactacaaaatttaataaagtacaaataaatactcttcttgtaataaacatggattttttgagctgctactacgcttaaactatttggttagtacgatgcctgctaataagtgttatctgtatagtaagtcgtgtctagtcccgcagtattatacgtggtgctgttaggattgctaaagaaatcagtgttcaattcgttgagcttagtttctgtattgtgcaatttcttagatgttaatctaagatttttgcgcaactggtctgacgcgctttgcaaattagcagtatcaattacttgataagaacttccgttgatccaagcttctcggccaacgagttgttttgtcacgacgtgcctagtacattgatgataatggctaattaatttttcgatttgctgcgtagttaagtcggtactaatatgcgagcctaatttgttcatcaaagttggtatcctaaacatatattgtggagactgcaatttgtggacgagctgcattaaaacttcttgttgtcgtaattgtcgtccgtagtccccacgcggatcctgataacgcatcctggtgtaagctaaagctttttcaccattcagatgatgggtaccctttgggattgtttgaccatcaaagctaaccacaatgtcagttttgacggtcaccccgcccacaaaatcaactaactcttttaaagcgcccataccaatggttacactgtaatcaagtggcatacctaaaaaagcgctcacagttttcttagcaactggtgctttaccaatctcataagcagcgttgattttctgaacgtcttttttagcatggttggtcttaatatggttggtcttaatttcggccaaagagtcccgtgggaccgaataaagcagcgtctgcttagtgcgtgggtttagcgttgcaaccatcattgaatcggataatcctctatcaatccggccgtcagatcccgtatcaacgcctaatagtagaaccgagaacggcttttgctgattaattttattagataccgaagaagtactagtttttatcgtcttaaacgctttatattcgtaaaacttaaaaactagcactccaatcaccgaaagcaccaacaccattgttgctacataaccaattacttttttcgctttcataatataatccctccaatcttagaaaacctattaaaaccagctataaatacaaacttacctacgttatatttaaaattcctatacaatcgattttattcagcagtcccagaattcatattttgacgggctaaaatttgttaaatgaagcccttgtaacgacgaatataggttgatttaacgactgtagcaagcgcaagatagctaaagattgttattactaaccaaatccaatagctgtctggtacagcggtcaagcttaaacttttgccaatcggagtaaatggaataacggtgccgatgacaatactcaaactcgtggttatcgttaggacggctgaggcactgctttgaataaacggaattttggcggttcttagcgcgtgtaaaaccatggtttgggaccagagcgactcgataaaccagccgctttggaaaagcgcgatgaaatacatttgatttggatgggtcaaatgtataaaatcaccgcccgcaatcgcgggacagataacgaaaaacattagtagataggtggtgatgtcaaagatggagctagtcggaccaaaccaaaccataaatttgccaatactgttaactcgccattttttaggcctttctaaatagtctttgtccatcgtatcccaaggaattgacatacaagaaaggtcataaataaagtttaataaaagaatttgaaggggtagcattggcaaaaatggcaggaagatgcttgcaattaatacggaaaacatatttccaaaattagaacttgcggttgctttaatatacttcatgatgttgccaaatacttctcggccaattaatattccatgcttcaaaataaccaagtcgcttgccgttaaaattacgtcagcagcttcttttactacgtctacagccgaattgacggatattccaacatcagccgctttaattgctggaacgtcattaattccatcgcctaaaaagcccacggtgtgtttattttttcttaacgcctttatgattctccgcttgttttgcggggttagttttataaaaacattattttgggtgactaccgggcctagttcctggtcggttaagtgatcaatattttcaccgcttactatgccagttacccttaagccgacttgttgacagattgatttagtcacaattgcattatcccccgtcaaaaatttgatggtaatcccctttgacttcaaggctgatagggcttgcttagcagtcggtttaggagaatctaagaacgatagaattccgataaagctgaggttggtttcatctttaacggaacaagtgttcggtgtggttgctaaacgcttatgagcaactgccaccacccgtaaaccagcttggtttaactggctaacttgccttaaaatttcgtgcttgatttctattgttagcgggaccaagctacctgtagagtaaaccgtattagtgatttcaagcatctcttctaccgcacctttggtaattagctgcttgagctttaacttccggtttagctgcgtcgataacggcctgatccaacggattattaaaaccagtttggtaacgactgtttaaatacgcccattttaaagtttcttcgtccgtcatccccttccaatttaaataatggtttaaggaaaattgattttgggttaacgtacccgtcttgtccgtgcataggacgtcaattgctcctaaattttgaattgcttttagatttttaatgatcgttccacccttggccattttagttgctcccttaaccaaattggtagtaacgatcatcggtagcatttcgggggtgagcccgaccgccactgaaagaccaaataacaacgcttctagccaatctcctttggttaaaccgttaattaggaaaataacggtagtcattattacggtgaattttataaaaaggtacgaagtttttcgaattcctagatcaaagttagtttcggtcggcgtaattgatgccgaatgggcaattccaccgaataaagtttggtttccagtcgctattactacaccttcagcttgcccgttagtgacgtaacttcccataaatactaagttttcgtagtccgtttcgcttttaacgtttttcttagattgcaaatggttcttttccattggatagctttcgccggtgagtgatgcttcagaaaccaataaatctttcgacttaattaatcgcatatcagcaggcaccatgtctccgacagaaagttgtacgatatccccgcaaaccacgtgatctactggaattttttggattccgttcgcccttttgactgtggtgacggatttaatcatggtttttaattgttctacggcttttgtagaccgtaacgactgtataagggtcattgttccgcttataattaccattccaaaaattattccgctccccagatagttacgttccccaggtggagctaaaactacgtcggtaataaaggacactaagccaatgcaaatcaaaacaatcgtaaacggcgtaatgtaggctcctaagattgtacggataattgattttttcgcattatccgttagtttattagggccaaatcgattgcgcattttttgaacctgggtttgcttaaggcccgtcgtcgtgatattaaagtctttaaataactcacgaatacttgccttagcaaatttttcgtaatttggttttaaattggttttacctacatttctcatttttctccctccttaaaaacctataaaagttgttgaggtggagacttcagggcaaataaaaaacgactttttgccccgaagctcagcaaaaagccgcatttagtttatagtaagtaaacgctgatctattcgttgagctttagcactatacaacgtaaaaatttttcaattttagctaccttaagaaaagccttgaattcgacaattcctgttctacccattagtgtctctcgacatttttgggcagcagcctatgtttgtataggagcctcacctaacaaatgtattcaattaaaacagagtaccctgttatggtttcatcatactttatatttacaaataaaactaacgcaaaccaaacacttaactaattatttatattttttcttgacggttaatagtaataattttgggaaagggacctcccctgttaaatcccgactaaattatataaaaagagcgactaaaaaaacacttttttgattatgctttttagtatttataaagttattcttcaagaggttcgcgcacggtaatgggcgactgttgcatgtaaaataattaattgttaccctagtaaagatatgcaaaatgggaagataagtgtagaaagaaggtttaaataatcgaatataaagactttatcgcatgtgtgacagtaattaaattaggacgtttttcttaaaaaataataaataaaggaagtataaaaatgaaaaacgtccaaaaacaagttccatctttaatgattatcatcgcattagtgggcttcccacaaattagcgaatccatcttcactcccgtcctccctgccttgagcgctaatttaaatgtagccgatcggactggtcagttagtaatgagcacttactttattgcttttgcggtgggggtattattttggggtaagcgttcggataccgagggccgcaaacctgcaatgttagaaggcttattagtctaccttgtcggcaacgtcggactattttttgcgcctaattttctagcgataattttctttagattgatccaatctttcggagctagcgtgggttcggtagtgacccagacaatcatgcgagaaagtttctcgggaagtaagggagctaaggttttcgctaacgtaggtgcggccttagccctctcccctgcgattggtcccctgcttggtggatacgcccaaacttactttggctaccgcagtgtttttggtgtgctaatcgctgttgcagtttcattgataatttataccggggcgcagttgccagaaaccaatccggcaatcggtgttaaaggacccaaaatttctttgattgcggtagttcggcgtctttttacagatcgtaatgtattggcctatggtttattgatcagtggaattaacggaattttatttagtttctacgcggaagctccgtttatttttattgatcattttcgtttctcaccagtccagtatggaatcataggtattataattgccttatccagcatcattggtgccataatggttaacaagttagtcttaatctggtcgcccactaagattattaaattaggtttgattttttctttatttggcggactatttatgtttctaacggttttacaagattcagtaatcggatttattactggtacctttattgttttcttaggtttatatactgtactccccctttccttaaaccttgctttagtaggttatgaaaaaattattggggtggctagtggaatttttagctttgcttattacctagtgattagttttctaacctatctaattagcgtgttccacactggctgggtcggcatcttaccaatttatatttttatagtagttgggatcatgtccctggtttattggtttagttttaataaacagtaaagcctgattcatttaaaaacaataatgattagctattaacttggttaatgaaagaccatcaactgaagatatacaaattattaagcaaatggattaattagtaagtaccttgcgtgctcctaagttaccttttttacggcttataattttggatattgttcggggatggtctttttatattagattaaatacggtagatgatttttgaattctaagcttcatacaaatgaatgtctagttgacatttaaaacaaaaataaaaacaataccctctattgaataaagcgctttcaagagatacacttaggatataaataaaaaggaaggcgacatttcatgaaaactatcatttacgtacatccctgggccggcagttttaatcacgcaattcttgaaaatgtgaaaaagaaatttgaccaaaaacatgaggattaccaagtaatcgatttgtataaggatcaatttaaccctactttttccgctgaagaactgagcatgttcaatgctggagatactccttatctaaaggttaaagagtatcaaaaaatgatcaaagattcttcagaattggtcttcatctttccgatttggtggttctacttgccaggaatcttaaagggcttctttgacaaagtgatgttgaaaaaatttgcttaccaagtcgacgaacaaggcacctggacggggctcttaaccaatattaagaaagtaaccgtcattactacggcttccatgactaaggaaattttaaaagctagcggtgatccaattcaagggttgtttattaacggtaccttaggatccgttgggattacgcctgataaagttaactggctgcatttcggaaacgtggaaactgcatctccagatgaacacactgtgttcttagaaaaaatacttgattagatataaaaacagccctggtaaccaaagatggttatcagggctgtttttgattattaccttataacaataggttatttattcaattttaattcattttctaaattaatcatttctatgacaccactagcacattcaattcctttattacccgatttgcctcctgccctgtccaaggcttgattcatactatcagtcgttagtatcccaaacattactggaactttgttatttaagcttacctgactaattccactcgaaacttcgttacatacataatcataatgagaagtttcaccgcgaattacagcacctaatgaaattatgccgtctactttacccgaattacttaatagcttgactacccgtgggatttcaaaggctcctggaacccaataaactattatattattagcttccactcccagctgttctaaaccttgtttagctccatctaataattttctagttactaactcattaaacttagcaacaacaataccaatttttttacctttaccattaagttttccgtaagcttctctcatactatcaaacctccgtaagcaaatgatgcattttttgttttttcgtttttaaataactcaaattattatcattaggattcatttcaagcggaatcctcttctctatatgaattccatatttagttaattgggtaattttatcgggattattagttaacaactcaactttagaaatccccttttgtttcaagatagctgcagcaatgtcatattctcgttcatcagcttgaaatcccagctttaaattagcatctacagtgtctagtccggcttcttgtaacatataagcctttaatttattggttaacccaattccacggccttcctgacgcaaatataaaacagctcctgagccctttttttcaatttgctgtaaactagctattaactgatctccgcagtcacatcgtaatgaaccaaaaacatccccggtaaggcattccgaatgcaaccgtaatagtagcgaatccgcgtgttttagctggcctttagatattaataaagtaggctcttggctatttggggtttcaaatacttctaaattaaaatttccatatttagttggcaaattaacttttgcgacgcttttaacgagttgctgatcttttaataatcggtagtacttgatttcttttaccgtaattaaaggcatctgcaacccttctgctagtgacttgagatctttttttctggccatcttaccgttttttttcaagatttccatgatataagcggctggagtgctattagcaagtttagctaaatcaacagcggcttcagtgtgtcctggtcgttctaacacaccaccctttttagcaattagcgggaatatatggcctggatgataaaaatcatcatactttgatagtggatcaactaattgtttaatagttttagcgcgatcatacgctgaaatgccagttgtggtacttttagcatcagtactaacagtaaaagcagtaccgaacgcatccgttgagtcgtcagtcatcgaatggaggcctaattttttagctaaatctaaactcattggaacgcataataacccacgtgcatgagaaatcatggtatttacgttttcaggggtaacatgttcagctagccccaccatatcaccctctccttcacgttcaacatcatcagcaacgataattaattgaccttttttaaaacctgaagagcttcttccactcgcgtaagtacgtcttttttaaccattaaaatccctctttttgctaagaatatacttgcctaaaatatcagtctcgacatttacttgatttccaatctttaagtatttaaaagtagtttctttaattgtgtgcggtatcaagctaacgataaaatggttttcaataacttttacaatggttaagctgacgccatctagagcaatcgaccccttttccacgatgtattgtttgaaatcattaccgatagtgaattcaaaatctatggcgttgtcgtcgacgacctttttaatcaaagtagccgtagtgtccacatgtcctaaaacaaaatggccatctattcgatcagttggcaaaagcgcaggttcaagatttacttttgtgccaactctaaacctgttaaatgcggttcttttagtagtctcgggcataacatctacttgaaatccgtccgtaaaaattcttgtgattgttaaacatactccgtttaccgcgatactatctccgattttgctattaatctcttttactaatgaagtagtaatttttattttagaagagttttgatgtcgatcaatttgagcaaccgccccataatcattaataatccctgtaaacatttacattctccttaacttaaactttgtatctaacccaatgaattctcggctgactaactgaaaattcgatgattgtgcagcttttccctgaacagctggtaatccttgaccgccaaagattttgggcgctacataaacaataatttcgtcaacaagattgctagctataaattcagcatgtaagtgactaccaccttcgattaaaagactctggaccccaattttagctaaatattctgcaatttttttaggattccatttagaatcgataacgatgttaattcctttaggccatctcttctttgaaaccgtccgggaaagtacaattgtttttaaatgatcttgaaatatttttaaattgtttgacagctggtcggcattattagctacaacgactcgccaaggttggtaaggcgtatttatatttctaacagacagcgatggattatcagtcaatgctgtattttcgcccaccaaaatagcttgatttgtaaggcgtaactgttgactatccgcgaaaacttcattcccagtgataaagcttctcagattagattggcgattaatttttccatctaatgtcatagcatatttaacggtaatgtacggccggccacggttatagtaaaagttatattttaaattttctggtaatttcaaatttaaatttgttacttcaatccccgcattttttaaaatcgaaactcccttacctgacactaatggattaggatccagctggccaatgacaacttttttaataccaacctcaactagtctagtcgcacaaggaggggttttgccaaagtgactgcacggttccatactcacatacattgtggcgccaaaggctgcgttgatgttttctaaccggtttaacgcatcaatctccgcgtgctctttaccgaattgatgatgatatcccgtagccaaaatttcaccgttcttaacgataacagccccaactaatgggttggtccacgttttgccctttcctttcaaagctaatttaaaagctaaatccataaaatcttgtttagtaatcaaaatcaccccatataaaaagccccgcactataaagtgtggggcggatttttgatagccaaaaagatttcatacgagagtatgccaaaaagcatacaaaaagagtacgaaattttcgcgttttttcttctcccatccagactatactgtcggtcctagacttgcactaggtcaaccgcaaaaaaagcgggtcacggacttcaacactgagttgtcaccgtcggtcgggaattacaccctgccccgaagaaatctattcagttttcgaaacagagtttactctttaataaaagtttagtcaaatacaactaaacaaactttgtatttttatttctcccaatgtccagttttaactttaaaatacacctgagcgccaaaaaatactaaataagatagccctaaaaatattaaagctccggtaatgatacctggcatttaactcacgctccctttgcttgattttattttgattgatgatatcataatagaaaaggcaaggggtgcctcccttgccacgccaatgggttttaatgtgcgagctaattacttaatgtgattagctttttttattatctcgtaagctttagccagaagcaaaatgccccggcataccacgtagaaagcaagcgcccacgccattaacaatccctttcaagttattcatatctgacacctccatgcctctggatttttttgaagggtgtcatataaaaactcaaacggcggcaatttttcggggattgcagatcccctacttaattacgtatccgattatatcattttgtttcagctgatcacattcccttccactttttaatgggtgtatgccagcagttcccagctttattaaataaaaaagagcgcgaaacaaactaacttttgtctcaccctcactgaaatagctttttaagatttttatccaattactcatcatttagtgtggttaaagctaactaccaaaccaatacccattttggatgacgtccaacattttagctagttgaaccgtttcggcaatgtcgtggactcgtaaaatccggccaccatgcagatacatatatgcctcagccaccagcgttaccgggagccggtcttcttttggtaacccgaacaatttagccccaaacccttttctcgaaatggcaatcatcatgggccggtttaggtaattaaactggtcgatatttttcatcatcgcgtagtcttggtagccatccgctttttttgcgtaaccaatcccctgatctaacgcaattcgattaatattaattccgttttgaactagcgtggcaatattttcttcaaagaacgccttcatttctgccgtaaggttatcgtaatctttattacgcgcgctgtgcatcgttagcagtccaatattagaattacgcatcagtgccagctttcgttggtcatcggtaaaggcattgacgtcattaatgatatcgacataatcgatcacccgttccattaccgcgtatttataagtatcaatcgctactgccacttgactaaagttcttttgaattaggtcgagtacctgggtaactcgtttgagctcttcctccgggggaatttctacaaagcctggccgagtagtttggccaccaacttcgataacgtctactccagcgtcaaccatttcagagacccgttttaagattgcggtttcactttgataccagccgccatcgtaaaaagaatcgggagtaacatttaaaatcccatagattacgggacgttcagtaaggttaaattcaaagcgaccagcttgccacagcacccggtgcttttgatttagatcgttcatttgttggtctaaactcgggtcattaaaaatttccgtcaatttttccttaaaaagggctaagttaacccgtggtaaaagtaggtctactcttagcccctccactgtatgaattaagtccatctggtctaatagtttggctaacaaccttaacttcgcagcgtcatcagcaattacctttaacgctaaataacgctgccggttaagcaggtcatcccatattttattttccaattgactgctaaattgtaaatgctgttcgtagatttccataactgattcctttatataaagtagctgtccaataaattctggaccgcctttgtccgatgcaatagcggtattttttcgtcgttaggcagttccgctagcgtagcgtttttttccggaacttccaatattaaatcaaaacttttcccattgctcccgcggggttcggcactaattttaccaacaaatttaccggttgctttaaggacgtgaggttggtttaccgccaccaaagtagactgcatggttacttccctactttgattggcaaccatctttaaaatttcttggttcaacgccgaatccgtagtttggtccatgtgtaaatctcgcgaagtagtgattcctaaactttgggggcatgcttttaacatcatcccagtatcgtcagccacaatccactttcccggaagtttttgagcaatccagttggccttggtaagcgcattttcggaataacttgtggtaccttccttaggaaaatcaactcgccctagcaaagcctggtacgaaatcgcctgctgcccaaaccattcaaaaatctgaatcagttccctagttttatttctattattggaagcaattataaagttagttggcattggaaacattcggcacctccagccccttgatcaaataaaatgaaccggtaactacaattgtcgtatctgcatcagctaatgttaaagcctgttgcaaagcggtatgtaggtcacgataactacccacgactttattgcctaacacggtctggatcgttgtcggacgtaaagcacgggttggattgtctggttgaaccgcaaaaacccgaccagccgctttagcatacaagtgcaacattcctgaataatctttgtcttttaagaaccctaaaataaaaaataatttgtgattggcgttcaaattggataatcccttaatcagggcttgagtgccgtccacgttatgagccccatctaaaataaccgacggatcccgttgcaaaacttgaaatctacccggaatctgaatgtgctgcatcatttctattagtggttgccaatcgctaatcacttgctgattaaacagccattcgtaaactgttaccacggtcgttaaattatcaatttggtaatcgcccagcaatttaaacgtcgtcgctgcaatgttagtggtcttggcatgcagactaactttgaacccagttatcgagcgctttatcacttgaattgttcccggaactgcttgaattaccgaagtggcacgtttttgaaccgcctttttttcaaggattgtccgcacctgctgcgtttgtttgggagcgataaagacggttgcatcttttttgataattcccgccttattttgcgcaatttgttctaaggtaccacctaaaatttgtacgtggtcgtaatcaatgtgggtgaaaacgaccgctgcgggatgttcaataatgttggttgcgtcattttcgccaccgagtcctgcttcgataattgcccactccacaccattttcagcaaaatattccaacataatcaacgtaaaccattcaaagattgaaatacttgccggtgcgatagctgagggaagtttttgcgtgattttttcgtataaagccacaaaagcttctttttcaatcatcgagccgttaatttgaatttgttcgcgctggtcaatcattgccgggctggaaaaatggcccacccggtagcccgcgttttcgagactttttgcaagcatagcgcctgtagaacctttgccgttggtccccgctaagtggatgattcgataatttaaatcaggatgtcctaaggctgcgaggactgtttttagtaatggaatgcgatcttggtggctaaccagcatgttatggtttaattttcgaattaattcttcgtaagctgttttaggcattttgttgtccgacctgctggaaaaagttagcccttaaagcttgatccgttttaaaaaccccggtcatttttgaagtataggtaaataagttcgattgattaataccacgcatttccatacataaatgccgtgctgacacggtaactgcgaccccttgaggatctaagatgttagctaattcggtgctaatttgggtagttactttttcttgcattccgggccgtttaacaacaaagtcaaccaaccggggaattttgctaatcccaatgactttgccatccttagggacataagcgacgttgacgttaccaaaaaatggtaatagatggtgctcgcataccgaataaaacggaatcttttgaactaaaaccatttcaggctcttcgtctacgtgaaagatcttataatcggtaaaatcggtcgcctggtggtttagtcccgcaaaaagttctgcataagctttcgccactcttttaggcgtttccaccaaaccttctcgttgggggtcttccccaattccttctaataaatcactgactgctttttcaattttgggtaggttcaatgttttcacttcctgaatcatatattctgaccatatttttgtccgaagttgcatcaagtaaagcttggattgcttgatgaagtttaggatcgtcctgactgacttccaacatcggaattaaaacaaaacgccgatttggaatctccggatggggaatcgttaattccggagaagacacatgatcgttattaaaaaataagatgtctaaatcaatcgtcctcggaccccagtggatgattcgtttacgttttaaagctttctcaatcgcgtgcaaatcatccaatagctcataagcactcttcgaagtcttaacttgaatcgccatgttaagaaaatcatcctgtttgacgccacccaccggttcagtttcataaatatgggaaagtcggctaacctgagccacctgatttaacttctcaattgctaattctaaattctttttacgatcccctatattactgccaatgcttaaataagccgtattaaccattctgttgaccactcacttctatttctacgttatcaaaatatccgttaatcgggacgctgtattttctaattttcaaccgcacggcttgaagacttggatactcacgtaaaatcaattctaataggtgattagcaacgctttcgatcaagtcatagttatgagttaaaacaaattcttcgaccgttttataaacggccgaataactaaccgtttcggttaaatcgtcatgtttaactcgttcttcaattggataagttagctcggcatcaatttcgattttttgccctagcttcttttcttccggtaaaacaccgttgtaagtataaaactgcatgttgttaattctaatctttcccaacgaaactcacatccaatcctcgttaatagttataataataccattaaaaatattccctaaaaactatgctgcatcagtaaaaaaatatgttaaacagtggaagccttggtaacggcccgttgataggttaatttaaaaattgaattaatgctaaacgcgaggtctcttttatgattaagtcgtaaaatcctttttgggagtcacaaaatatgtcaactcggagaattaaaggggaatttaatcgttcgaattaaaaaaattatcccaaaaattagatttcagttcataaaagattaaaatttaattacatacattctattgacttttttttctgctacaattatactcatatttaatttatttttattcataaaaggaaaagttaggagaagatattcaatatgggtgaacaaaagaaaaaactatcgctcggcgctttagttttgatgatatttaccaccatctttggttttggtaatacccctactgctttccagcaaatgggttacggagcaattttttggtacattttaggtgcaattttattctttattcccgctggcttaatgtttgcggaatacggggcaacctttaaggaagctaaggggggcctttactcctggttggaacaatccatcggtgaaaaatgggccttcatcgccacatttatgtggttagcttcatggatcatttggatggtaatgatcgcacaaaagatttggattaccttggcaaccatcatttctggtcacgatactactggtagctggtcactatttggaatgaattcaaccatgacgattggattactcgccattctatgggtagtatttgtaacttgggctgcttctcgaggaattaatactttggcaaaggtttcctcattaggtggtttagccgtaatggcaatgaacgtaatcttactattagctagtgtgttcattttaatcgctaaccacggtcacttggctcaaccaatcaatcatttaagtgattttgcaacttcgccaagtgcccaattccaaaaccccatcgcgatgatttccttcgtaatttacgcgatcttcgcttacggtggtttggaatccatggggggaatcactgatagtttagataagcctgaaaagaccttccctaaaggggttatgatcggtgggatcgtaatcgcggtaggttactcatttgcgatcttcctctggggagtttcagcaaactggcacaccgtaattttggaacaaaaagctaacttaggtaatatcacgtacgtaatgatgcagaacttaggattagaattaggtaaagcaatgggcttgagtagttcagctgcagttgcgttaggaacggccttctcaagattctctggtttaggaatgctgttagcttacgttggttccttcttcgttttaagttactcaccattaaaatcattcatcttaggttcacctaaagaattgtggccaaagaaaatgaccgaactaaacaaaaacggcatgcctgctaactcaatgtggttacaagcaatcgtagttagcgtatttatcgctggaatttctattttagcttcaattactcacaaagaagccactttcttctacaacgtgttgacttccatgagtaacgtttcaactactttgccatacatcttcttagtaggagcatttccattcttcaaggctaaaaaagaccttgatcggccatttgaagtttaccgcagtcggccttggatgctaaccatcgttacggtagtgttaattaccgtcggcgtcggaattgtctttaccgcaatttcaccgttcatttccggagacttgttcaccggattgtggaccgtggcaggaccgttattcttcggtttaattgcttgggcattcttagttagacgtgaaaagaataaaaatatttaataaataaaaaatcgtaagtttcaagcatgtgcttggacttacgatttttttatttgcgcctttttattgccaatgggtttgtttaaattgacttcgcccgccagcctcttcaatttggtatctccgcggattctttttataaaattgctggtgttcttcttccgccggataaaacggttgggcatcctcaatggtagtgacgatcggttcgtcaaatctacctgattccgcgagtgctttacgggaagccaacgcaacctggcgctgttcttcgctgttaacgtaaattaccggtcgatagctgtcccctcggtcttggaattgccccatcgcgtctgtagggtccgtttgttgccaatatatttctactaactcccgataagaaataatttcaggatcaaaagtgatctggaccgcttcagtatggccggtggtgtgcgaagctacctgttcataagtggggtttggtacatgtccccccgtataaccagaaacgacgtttaagattccaggctgcgtttcaaatggttcgaccatacaccagaaacatccgcccgcaaaaatagctgttgatgtcataagttacccttctttatcaaagatttttttcaaatagccgaggtgatgctcttccaattcatcgtacgggatgaacttcagcgctgccgaattaatacaataacgcacgcctccagcttcttgtggaccatccaaaaacacgtgtcctaaatgggagtcagcttgtttgctgcgcacttccacacgttccattccccaggattggtcccggtgttcggaaactaactgagggtcaattggttggctaaaggctggccatccacagtgagcgtcatatttagcggtagagctaaataatggttccccactgactacgtcaacgtaaactcctttttcatagaagttatcatatttcccgctaaagggacgttctgtagccgcttcttgcgtcaccgcatattcttcaggactaagcttttcttttagctcggctttagaaagttttttgttctccatttgcagcactcctaaccactaaaatgaatataaatacatatttatgggtaattttgtttaattaaccccctaaatatacaattggaagattaaaatagaattagatcttcgatcattgtggctacattataagctgaatattttcaaaagcaaataattggcttgcccgtaaattatgggataaaaggggccttatttgaccgaaccaattcctttcttgattaaccgagcgatattctccgcaacttgcgcaacatcatgaggaccagttgccaaagcttcgcgtagcgacttaactccggatacacttgtaaaaattgcgtcaattgcgttgtctgcgtataattcatcaattcccttgccgacgttaccagcaattacaatcaccggcgcatctggagcaactgccttagtggttaatgccaccccatagggagttttgccatacttagtttgaaaatcgattcccccttctccggtaaatacgtagtccgcattttgcgccttattttttaatccgctgtattcgattacgatgtcgatcccttttttcatggttgcgttagtaaatgctactagcccggcacctaaaccgcctgccgcacccgcaccagggcgattagctaaatcaagccctaaatcgcgctgtaagacttttgcataatgagtaaggttttgatccagaagttgaaccatctcgggagttgcgcccttttggggaccaaaaaccgccgatgcgccttgtttaccaattaagggattagtaacgtctgaggcgatgataattttcgtttttttgattcgaggatcgatttggttaaccttaatttgcttaagttgatttaaattgcccccgcctagttgaatagcttgacccccatcgtctagcaactctgctccaagagcttgggccattccggcaccaccatcgttagtggcactgccaccgatgccaatgattaaccgatcaactccttgatcaagtgcctttaaaatcagttcgcccgtcccgaaagtagttgtttttaatgggttccgagtggttttagtaacgtattggattccactggcttgcgacatttcaatcacgccggtatgctggtcacctaaaattccataagtggcgtttacgggcttaccaagtggaccggtaacttcagcagtcaacagccgtcccttagtagcgtcaactaaagattgtacggttccttcaccaccgtctgccatgggaacgagtgtataagtcgcttccgggaaaattcttttaagtcccgttttaatggcgttagcggcttgtttagccgtcattccatttttaaatgaatctggtgcaatcacaaatttcattattctactcctttattaaaagaatccatacattaaggttgcaacgatggtcattgacaatccgaccaaggtttcatagataattgaacgagaacgttccttaatttccatatgcatggcattggccgtaacgtgaaagtaattcccgtgtggcaagtgatcaattaccgtcgccccagtatgtaccatcgcagcagcgcctaacggacttaccccaaaacctaaaatggccttactaaaggagcccgtggctaagataacccccgtcgacgttgaagcagttgctgccgccattaaaattccagctaacggcgccaagaaaattccagaaacgtggctgattttgattaattcaataattttatttggcaaactagacgtggtaattaacgcgccaatcattcctgccccgattaaaatcatgactacgtcggtcattcgggcaattccagattgagcgtaagcctttaattgccgtccctttcgcattgctaacgtcccaactacggcagcaaagggaagcacgtaggtggcatccaaatttaaattagttaaaccgtgaatatgtaaaagtgaacttaacggatttagtagcaacaaaacaatcgctaaaatcggggttaccaaggctgtggccaatgatggcaactccgtaggttgcttaggcttagttaaatttgcaatatccgtatctaagaccgcactcccgcgatgtttcaaaaaggaagccactaaaactgccacaattaaaccaacgacgctgggaataaagtttgcaatcatgatctgacttagattaacgccaaacccttttgctgcagcaatcgaattgggatttggtgaaataatgtttccggctttgccgcctccggaaagggcaactaagagcgccaattttgaaatatgcatgcgttggccaacttcaagcgcaattggcgcaacgattaagacggcaactgggataaagactcctactcccgtaattaccattgtcgctaatgctaaactaaatagcgctaactgatcccccagtttgttaacgatggtcttagcgatcacatccgctgcgccggattccatcatcactccggcaagcattccggctgcaattacccgtaacacagttcccataacgctttgcgagccttgaatgaggacgttaatggtttggctaagtcctgctccacctagcaaacaacctaaaattgcccccaacattaacgaataaacggggtttaatttcttgagaataaggataatggcaacggctaaccccactagcgctgcccaccatggtaataaatgcatgaaatactcctttcttgtcaatcaattcacataacattatacagctaatcacaaagtaaaataacctccttttcaaaagtaagcgcttaacttagcaaatatataaaaaggccctccgttaccagatcctcacccttcagtgagctttggtagcgaagaaccacataataattattaatcttttgctgtgttcttaaaacggcgccaataatttgccaaatattgggtggtgagactttgagggtctttaattaattcaccaggctgaccggttgcaacaagcttgccaccgttttgaccaccagtagggcctaaatcaattaagtaatccgcatttaccattaaatcgagatcgtgggtaatcacaataatggttgcctgtcgatccagcaaacgttgcatgacttgtagaagtacgcggacgtctaaaggatgtaatccaatggttggttcgtcaaaaacaaatagggtgttggcttgttgctgattaagatgcttcactagttttaagcgttgcgcttccccgcccgataagctaggagtgttttcacccaaatgtaagtatcccaacccgacttccattaagttttgcaagtcttgttgaatcttgggttcgtccttaaagacggcaatcgctgattttacgtctaagtttaaaacgtccacaatcgacaaatcgtgccatttaatttgctgaatttcaggattgtaccgttctccatgacaagttgggcagacttgttgcatgtctggtaaaaactgaatatctaaagtaatgcttcccgtcccaccgcaagtcgggcaggcgccctgcttgttattgtaggagaagtagcttgccgtgtactttcgtttttttgctgcaggttggctagcatatagtttacgtaaattgttcatgatattagtatacgtggcaaccgttgatcgaacacttttgccaattggttcggcgttgacgctgactaccttttttaacggagtttttagctgcgttacttgtttagggagactacgtttttgagattgcgcggtaattgctgggactaaactatctaggattaagctggtcttccctgcgccggaaaagccggtaaccgtggtaagccggttgacggggatttcagcccgcacattttgtaaattgtagtagtctttaacggtaaaatcgattaatttagcagggtcctgattattgattttccggacgtgaatcattgccgttcccttcaagtaagggccaatcaaggaatcgggatcttcggccaattctgctggagtgccttgattcaaaatatagccgccttcctgaccagaaccggggccaatttcaataatttgatcagcagcgcggataacggctaaattatggtcaacgaccaccaatgaatttccttgatcaaccaattcccgaaaaacttttagcaaaccactaacgttatcgggatgcaaaccaatggaaggttcatccaacacgtataagactcccgtagtctttgtacgtaaagttcgtgctaattggattcgttgtagctcccctgtcgaaagactattaccgtttcttgaaagggttagataatctaaacctagatcgagtaaaggacgtaagttatggctaaattcagcaaacaaactatccgccatcttttgcatatccgcgggaagttctccgacgactttttccatccaggaatttaagtcgcctaaggcaaggtcagaaacttcggcaatattttttccgccggtcgtctgttgcattaattccggtttcaaccgacttccgtgacagacgggacaagtcgaatagttaaaaaattgacttatccgggcctgcgcccgttcacttttgctcgttttagctgattcgagcacggcctggtgcgcattttcgtataaagcgttaaaatcatggaaaacccggccggttcccgaacgaaagtccatccggtattttttctggggaccgtttaagataaagtccttttctttagcagtcaattctttgtaaggcacgttaatccgcacaccggcctgttcggcaaccttgggcataaagtttcttcctggaaggtgccaggacgcgactgcaccatcagcaacactaaggttaggatcaccgattaatttatcttcgtccagttgccggacttttccagtcccctgacaacgttcgcaagctccgtcactattgaaggaaaattgctccgcactagggacgtaaaaggcaactccacaaacggggcaggtgattctacccattgcatcgccactttcactcattgcttgagcaattgctaagctgggctttactcggtgaccattggggcaaacgggcgaacctaaacgagaaaaaattaaccgaattacgtttaaggtttcgctcatcgtcccaaccgtggccctttcggacggaacgctcggtcgttgccgaagcgccaaagcggatggaatatgttctacgctagtaacgtccgcctgtgagcctagtttaatccgtcttcttgtgtaggtcgacagggcttccaaatatcgccgagagccttcctcataaaggattcccatggctaacgagctcttcccggatcccgaaaggcctgaaattgcaacaaattggtgtaaaggaatgtccacgtcaatattttttaaattatggacacgccctccgcgtacgttaatttgggttggtaagactgcttgattttccattactgcttatggttctcctttcgaataacaacacctttattataactaaaaccgtcgcttatccaaagtaagcccacttttctaggcgtaaaaacgtgctagcaagattttatcgcataatcatatccaggtattaaaaaacaggccggaaaattagatttccaagcctgttcaataagatttttattgatgattattcaaaagccttcataagtggcggtaccacttgcttcttccgggatacaacgccaggaaggtcggcagtgttatggtcacttaacttaacgtcaaaggccttttcaaccatttccttaggttcgccaactactaatagacgagaatcacttgtcaaaatgttagttgccaatagtaagaacatgtcgtaaccgttcttttggttttcgtcttccattgtcttaactaaggcatcttcacgagcgaacacgtcgtccaaatcaacggtgtttacttggccaatgcgaactttcttaccgcccatgtcgaagctctttgcgtcgccatcaaccagttcaagttcactcttgcttgataaatcagtgcctgcttttagcatcgccaaaccgtattcttcaacgttaacgtcagcaatcttagctaaagtttctacagccttacggtcgtcatccgtagtggttggtgacttaagtaaaagcgtatcggaaataattgctgaaagcattagcccagcaatcttagctggaatttcaatccctgcttctttaaacatcttggttaagatggtgcttgtgcagcctactggttcagcacggtagaatagtggttgagcagtttcaaagttagcaatccggtggtgatcaactacggccgttaccgtaacttggtctacatcttgtgcactttgttgcttttcattgtggtctactaacattacagagtccacttcgttagccacggtttcaactacccgaggagctggttcgttaaagtgatttaaaacgtattccgtttctggattagggttacctaatgcaacggcttcaacgtcctttacgcccatttgagtttggtaatatgcaaatgcctttgccgcaacaatggcatctgtatcagggttagaatgtccaaaaataagttgtttagtcattatctgaatgctcctttaatctattattagttatctcttctaatctttcagtatacccttttttggctaagtatgcctcaaattcattcaaaaagctttcgattctcggaatgctatctttatctcttctaaagacaaagtctaaatcaaacgaaattaccggatccaacttagccgtaaagactccctttttacgtgggtgagccattacgtatgattctggcaacgcggttaccacgtcggtcgcgttcacaaaatgccgaatctggtcgggagtggtaaagcaagcgacactatgcgggcggttaactaaggcatttttataagcctctttgattaccccatctaaatagaattcttcagggtaagttacccaattatagttgattgttttttgcaacttgatccgcttttggcgagcgattttttcatcatgatgaataaaaactaagctttcactcgtgattttgcgggactggtatggtttccagtttttaatactgtcatctggcaaatacataattgctagatccactttattattttctagattttcccaaatttcttttctagtcagcatgtggacaatgattttaattccgggttccttttggtaatagtgcgcaataaaatcttcgaaaatttgggtctcaatcgaggataaaattccaattgaaatttcaccttgacttgcatttgacgactgttgaatttcgtcagttgcattattcaagacacggttaatttcatgactagcacttaacattgtgtatccggcatcggtcaaccgcaattttttccctaccgaataaaatagcggcgctccaatggtgtgctctagctttttaatttgctgggtaagcgcaggttgcgtaatccctagaatttgtgcagcttgcgtatagttcatcgtatctgaaagttgcaaaaaatatgtcaacgcttttgaagaaaagatcttttcttgtttagtccgcacgttcgtacacctcgagtttcattaagcttaatcgtctaataatcattataattaagtttaatattactccctgtaaagagcaaggggtaatcgctttatttcgcttcgttgactgctggatccaatgttttcaagcgcattgaaagcggattaccctcggagtcaatatcgatcacaaaactaccgttggaataacgttcatttaacggatgttccatcggcagaatgtcatgaactaagccgcgagaagttagaacttcaaaggcttggtgttcgttaactaccgcaatatcaaccacccggtgaggttctttcttaagttcacgcaaaatttgtactccgcgccgagctcgactcgttacgctaatttcactaaccttcatccgcttgaaggaaccgcggttagttattaagccaatctggtcttcatcgttaactagcacaaagttagctacctgatcatccctcaagtccattgatttaacgccggcagcccggggtcctacggttggaatttcaactaagtcgtagcgtaaaccataaccatgttcactcgctaatagaatggttgctggagcagttttaggatctacttgcacaacgttaactaccttagcaccttgctttttcagcttagcgtaggtaatggcttttttacgataggttcgccctggtttcaaatcttgcaaagcagtttgcttaatgtatccatcgtccgtcgcgattaagaagttaattggttgtttaaagtttttgacatcataggcctttaagataatttcatcgtcagctagcccaattgtctgtgaaacatgttccccagtatctttccaacgcgcttcggtaatttcatataccgggcggtaaatcaaattacctttattggtaaacatcaacagatgatctaacgtgttcaattcatgtttgaaaacgggttggtcaccatctttaaggccatcttcatccgcagacgctttataagaacgcaagctgctgcgttttagataaccggcttggctaactaacaccatcacttgttcttccggtacggtaaccgtgcgatcaatcttaatttcttcaatttcgtcctgaatttctgataagcgcggtgtggcatattgctttttaaccttccgcaattctgctgataatacccgagataacttagctggatcgttaagaatttggttaaactcggcaattgattcgtttaattgctgagcttccgtctttagctccgttacgtcggtattagttaaacgataaagttgcaaggaaacgattgattcggcttgcttttcactaaagtcaaaccgttccaccaagttatgcttagcatcctttttatccttactaccccggatagttttgattacttgatccagaattgaaagggccttaatcaagccgtcaacaatgtgtaaacgggcctctgccttttgcaaattaaattgcgttcgcttagtgatcacttctttttggaagtccacgtaagcttgaatgatgggcttaagccccattcgttcgggacgtaacttattgattgcgaccatgttgaaattataagaaacctgtaagtcggtgttctttaatagatagttgagaaccccttgggcatcaacgtccttctttaattcaatcgcaattgataagccttcacggtcggattcgtcacgtacttcagcaatcccatcaatctttttcattacccgaatttcatcaatttttttaactagttgcgctttattaacttcgtaaggaatttccgtgattcgaatttgctgtttgctaccacgcaattgctcaatggctgtccgagaacggacgaccacccggccccgaccggtcttataagcttgttttaagccgtcacgtccttggacaattccaccagtgggaaaatcgggacctttaacaaattccatcaatttttctaacgaaggatccggatgtttgatggtatataaaacggcgtcaattacttccccaatattgtgtggaggaatttccgtcgcgtaaccagcagagatccccgttgctccattcaccaagaggttcgggaaacgcgccggtagaacggtgggttcgtactccgtatcatcgaaatttagcaccatgtcgaccgtttctttgtcgatatcttgcagcatttcttcggctgcctggctcaaccgcgcctcggtataccgcattgcggctgggggatcattgtcaatcgaaccattgttaccatgcatttcaattaacggcactcgcagtttccagttttgactcatgcggactaaagcttcatagatggaactatcaccatgcggatgaaaattacccattacgttaccgactgatttagccgatttacgaaaggctttatcatgagtattaccatctttattcattgcaaagaggatgcgtcgttgcacgggctttaagccatcgcgaacgtcaggcaacgcgcgttcttggatgatatatttagaataccgtccaaaacggtcgcccataatatcttcaagtgctaattcttgaatttttgattgattatcagccattcggattccccttttactctagttattttctaaatctaattttaattcttcaaacgtttcgttttcttttcctttaggggtagttggcttagattcatgttcagctttaacagcttcgttatcaagcaagctaccatcctcttcgagggtgaaggaaacgttgctttcaatccacttccgacgtggttcaaccttatcacccattaaagtggttacccggcgctcagctaaggtatcatcatcaattcgaacccgcactaaggtccgggtatccggattcatggtggtttcccatagctgatcggcgttcatttcaccaagtcccttaaaccgttgcaaggaaaaaccgcggcccatttttttgctaacttcctcaagctcttcatcggtccacgcgtattcaatcttggtctttttattagcgcccttttgtagcttataaaggggtggcaaagcgatgtaaatcttaccagcatcgatcattggacgcatatatttataaaagaacgtcaacaatagtgtctggatatgggctccatcggtatccgcatcggtcatgataattactttgtcataattgctatcttcaaccttaaactcggggcctactccagcgccaatggtgtaaatgatcgtgttgatttcttcgttttttacgatgtcttgtagtttagctttttccgtgttcaaaaccttaccacgaagcggcaggattgcttggaatttacggttacggccttgcttagcactacctcccgcagaatccccttcgacaaggaacaactcatttttcttagcgtttttggattgagcaggagtcagtttaccagataaaatccgatcttgctttttgcgacgtttgccggtacgggattcgtcccgtgcttttcgcgcagccacgcgcgcatcgcgagcattgattgctttacgaactagttgttgagcaaattccccattttccatcaagaagaagcccagttgttcactaaccacggcttcaacaattggacgagcttcaggagttcccaatttttctttggtttgaccttcaaattcaagtaattcttcaggaacccgaattgaaattactgccgacaaaccttctcgaacatcagagccttccaagtttttatctttttcctttaaaagtccgacttttcgagcaaattcgttaaaggccttggtccatcccgaacgcatccctgcttcgtgggtcccaccatccttagttcggacgttattaacgaatgacaacacggtttcggagtaaccatcgttatattgtccagcaatttcaacttcaatgccgtgtttagaaccgtcgaagtacatgatatttcccagagtatccttatcttcgttaaggtattctacgaactccttaatcccttcttcataaagatactcttcagcttgttcatgtcccgcacgttcatcagtaagggtaatcttaaccccctttagtaagaaggcagattcacgtagtcgaaccgctaaggtattaaagttaaaaaccgtcgtggtaaaaatcgtcggatccggtttgaaagttaccgtcgtcccgttagattctttggtttttcccactttttttagcgttccgaccggatgtccgccattcacgaagttttcttcgtatttcattttatcccgaacgatttccaccgttagtttttcagacaatgcgtttaccacgcttgcccccactccgtgcaatcctcccgaagtcttataaccgccttggccgaattttcctccggcgtgtaaaacggtaaagattacttcggcagtcggtttgccagacttatgcattccaactggcattccgcgtccgtggtccacgaccgtaatactgttatctgagcggattgtgacattaatttcttttccgtacccagctaacgcttcatcgactgcattatcaacaatttcataaacgagatgatgtaatccgcgtccatcagtggatccgatgtacattccggggcgttttcgaacggcttcaagcccttcaagcacctggatggaagaatcatcatatgttgttttacctgtttttgccattcacgttactcctttaaggtcagtactattatcataacttatttttaatctgatgaaaacatttcgataaatgttataatactgcattgtgactgaaattttatcactgttaaaaaccgtgctaaaatttattgaaacttaaattattaattagaaaagaggaagtcccatgttaaagattttaatcatgttggggattgcctacttattgggctcgattccctcgggagtgttggtcgccaaacattttaacaaagatttacataaagaaggtagcggaaacaccgggacaaccaatacgtttcgggttctcggcgttaaacctggattactagttttgttaatggaccttttaaaaggaactttagccacgttacaacccatcgtttttcatgttaccacggttaaccccctcattattggcttagcggccattttagggcacaccttttccgtttttgacgaatttcgtggtggtaaagcggtagccactagtgcgggaatgctgttagcgtacaatcccagctacttcatcattgcttgctgtctatttgttggtttcatctacatttccagcatggttagtttttcgagcatcgtttcggcagtcttactcgttattatttcgtttttctaccatgattgggtgctttcagtagtggccattgggctaactagttttattatttatcgtcaccgttcgaacatcagtcgaatcttgagcggaaatgagaacctggttccctttgggatctattaccgcctcaaacataaaggctaaactaaaaacccttgaaacttatcttagtttcaggggttttgttttttagaagaatgaaattgtgaagctttggttaaacgtctctccagcggctaattggttcattcctaatttttcactcaattcgccattaaagtctacggtatccgcaatcccccaccaaggttccaaacaaacgaagtctccttcagcaggatatggggaccaaattcccagataaggcgcatcttccactgtaagggcgaccccatggtcattaacactattttctagcattacggtcgttgactttcgttgaaggtcaaaaattaatgcatcttcagcgaagagctcgtgacttaacgcaattggctgcgtagcatcaagatcctgcaaatgttttggatctgtgtaaggtgcttgtaacggaatttgcttgaaaacttttttaggagcaatccgcatttgactttccgccatcctgatccttgggtcacctaggttaaggttaaatcccgggtgaccgccgattgcaaaccagaggtcggccttttcagccggattatgaacttcgtaacgttcggttagttcgtggtcgtgtagttcaaaatgcaaccgtaaatcaaaatcaaacgggaatttttcgcgcgtttccgcggtactctttaattccattaccacttgttcgtcacttgctgaaatcaccgtaaagcgcatgtcgcgagcaaaaccgtgttgccccattggataacgcataccgttaaccttaaattgatcgtcttttaagcgacccacgaacggaaagagaacgggagcatgtctcccccagatttggggatcggcttgccaaacgtactcaatttggtcgtcgttagacttaacgctggttagctccgcacctaattcatcaattgtgaccgttaaaaatttattttttaaaactgccgccataaaaattgcctcctacaagataaactcgctcaagtctttgttacccgcgatgctaccaatcttactatcaacgtatttttcggtaatggttacttcgcccatttccatcgatggtccttcaaagaggatgtcttccaatagtttttctagaatagtatgcaaacgtcgcgcaccaatgttttccgtttcatggttaacttgttcagcaatttcggcaattcgttcaattgcttcgatagtaaaggtaactttcacgttatccgtgccaattagggcaatatattgcttaaccaatgcattctttggttcggtaaggatcttgacaaagtcgtccttagaaaggtcgtttagttcaacccgaattgggaaacgaccctgcaattcagcaattaaatcgctaggcttgctttcgtgaaacgctcccgaaccgatgaagaggatgtggctggtgtctaccaaaccatacttagtgttaacttgagacccttctacaattggtaaaatgtctcgttgcaccccttgccgggacacgtcgctagaagtgttttgtcctgaaccagtgatcttatcaatttcatcaataaagataattccggtgttttccgcccgttggattgcattatgatacagatccccatggttaactaatttgtcggactcttctttaattagaatttcacgagcttcccgcacgggtaccgttcgactaattttcttctttggtaagagcccgctcaacgattcgttaagatcgatgcccatttggttcatcatgttgttattattattttgcttaggatcgtccatttcaatggtgaccatctcgttttcgaggagtcccttagctaacttgcttgccgtgtccatccgcttttccttgatgtcatccggcacattttgtccacttggttgaaaatcagttggtgtctttccctgttgcatttgcgtaaacatgttcatcatgttttggaagtctaccgctgaattttgtttaggatcttctggaaccggtacaagcaattcgacgatgcggtgatccgcattcttagcagcttccatccgaacatctttgaaagctcgttcttcttctagatgcacggcgttttcaactaaatcacgcaccatcgactcgacgtcccgtccgacgtaaccaacttcggtaaacttagttgcctcgaccttcacaaagggagcgttaacgattttggccaaccgccgggcaatttcagttttgccgaccccggttggtccaatcattagtaagttcttgggggtgatgtcttcttgcatatcggcagaaagctggagtcgccggtaacgattccgtaaagcaaccgcaacggcacgcttagctgatttttgaccaattacaaattcgtctaattgattaacaatttcttgcggggttaggttctcttttaacattgcttacttgtcctccttgaaatctaaggcgattacgttgtggttagtgaaaatatcaatatctccggcaacgttgattgcggttttagcaatttccttagcggtcatatccttggcgtgttgttttaaagccttagcagctgctaaggcaaagtttccgcctgaaccaatggctaaaattccatcgtccggagcgattacttccccacttccagaaaccaggtacatttccttttgatccattacgatcaacatggcttccagcttttgtaactgttggtcgccccgccagatctttgccagttcgacagaagcgcgttgtaaattaccgctatattcggataatttcttttcaaatttttcttccaggttgaaagcatcggctacactacctgcaaaacccacgatgacttttccatcgtaaattctgcgaacttttcgtgcagtgcccttcatgatgaatttttcacccatggtaacctgaccatcaccggccatggcgttttccccattgtgattaatggcaattatggttgttgcgtcaaattttactggcataatgttctccttcattaagattaagacttagtcgagcgtggaaaaaacttccgatagctctcttgtaatttttcttttgtaacgtgcgtataaatttgggttgttgagaggctagcgtgccctagtagttcctgaacggttcgcaaatctgcaccattgtttaacatagcggtcgcaaaactatggcggagcatatgcggatgaatttttccgttcaaactactgttcttgataatttggtttaaaacatattccactccagccacggtaatcggttgtccataatggttaacgaacacgtattgatgagtttggtgatacttttccaatagaccggaccactcgttttggcggtaatcctctaatgcatgcttagcataacgaccgaagggcacgtagcgttccttatttccctttcctaaaactaggatggtctgcatagaaaagtcaatatccgtccaacgtaaattagtacattcactaacccgcatcccggttccgtaaagtacctctaacaaagcaacgttacgtaaatgcaagggaccttgatcttgataaaccgtatcaaaaagctggttcatctctttttcatagaaaaaacgcggaaggtggtcagcgtgcttttttaattgcacaaattcaaaagggtttttggcaatcacgtcattttttatcaaaaaacgataaaaagcacgtaaagacgagacttttcgtgagattgaggttctttttaaattttggtcaaagaggtaactcatgaagacgttcgcgtcaaaacggtccactgctaaaagctccggtttatttccggtagtctgaagaaacttttgaaattcttgcaagtcttccagataagctgtaaccgttttatcagaatactgccgctccacggttaaataccttttaaattgctctatccagtccataaaaaaacctccaacaattgacactgtagcaaattgtggagggaaactcaatttatttattgttttttaagctatttttgaggttcttcctcgtagtcatgatttggacaaacgatttgtttaccgcccttaattttcttttcaattaagaagctgtgacatacgggacactcccgcgcaattggcttgtcccaagagacaaattcacaatctgggtaacgcgagcaaccgtagaatacgcgtccacgcttggatttgcgttcgataatctgtcctttatggcattgtggacaggttaccccaatttccttaacaattgcctgggtgttacgacagtcagggaaccggctacaagcaaagaatttaccgtagcggcccattttaactaccattggtgccccacagatctcacagttaaagccggccggttcgtctttaatttgaatcttttcaatttgcccctgggctttttccaattctttagcaaacggcttgtaataccgatcaactaccttaatccaattttccttaccctcttcaatggaatcaaggtctttttctaagccagcggtaaaatcaatgttaacgatgtccgggaagaagtcgtaaatgatttcgttgacgatttctcctagctccgttggttcgaaacgccgggagactaacttaacgtagtagcgacgttgaatcgtatccagggttggtgcataggtagatggacgaccgacgccgttttcttccaaagccttgatcaaggcggcttcagtatagcgggctggtggctgagtaaaatgttggtttggattattattaaccagcttaacttgatcgccttcggcaaggtttggcagcacgttatccttgtccttattagttttatacacctttgtgaacccttcaaacttggtcttcgaaccgtttgcccggtactggacgtcgttttgttcaattgtaacggtcattgtatcggaaacttcgggcgtcatttgacttgcaacaaaccgggcccaaattagtttataaagcttaaattggtcgttattaaggtactctttaatttgttccggcgtccgcttaaccgaagaaggacggatcgcttcgtgggcgtcttgcgccccttctggcatcttccccttccgtggcttagtagccgcgtattctgcaccgtattgatcatgaataaataaggaagtttcgtgcttagcaacttctgaaattcgggtcgagtccgtccgcatataggtgatcaacccaaccgttccttctttaccaatgttaattccttcataaagctgttgagcagtcatcatggttttacgagtccgaaaattaagggttttattagcctcttgttgcatagaactcgtggtaaacgccgctgctgggtaccgcttccgttcacgccgtttaacttccgtaatgtcaaagtcgcctttagggtcaatgttctttaggacttcttgaaccttttcattatttggtaacttcatctttttatggtgcataccataaaaactagccttaaactttgaacggccctttttaaattcagaatcaattgaccaatactcttcgggtttaaaggcgtcgatttccttttcacgtttaatgattaagcttaacgcaatggattgaacccgaccagcactgaggccctttttaactttttgccagagcaatggtgaaattgaataccccactaaccggtctaaaatccggcgcgcttgttgggcatcaaccaaggtagtgtcaatgctgcgaggggttttaaaagcgtttttaaccgcgtctttagtaatttcgttaaataccacccgattcttatctttcggatctagtcctaataggtaggaaaggtgccacgcaattgcttctccttcccggtccgggtcagaagcaaggtaaacttttttagcctttttggcttctttacgtaaatttttaatggtgtcgcccttaccgcggatcgaaatgtagtggggttcgtagtcgttttcaatatcgactcccattttacttttcggtagatcccggatgtggcctaaactagccacgactttataagagcgacccaagtatttttcaatggtttttgccttagaaggtgattctacgatcaccaagttttttttagtagtcggcatttgttgctcctttgccttaaattagaatttatagtcaccacgttattgcattagaatctaaattgtcaaatagcgggtaccaccctaagcgattgacgtagtctctgatagccactgttataacggtgctaatcaagtttacatattagcacgacttttttaaaatgtatatttatctttgtaaaccaacctcttcaagaacgtcatttaaagagattaatgggcgtgctcccgcagcaattagctcgttggttccccgactattttcgctaaaaatactcccgggcaccgctaaaacgttgcgattttcccctaaagctaggctggcagtaattaaactacctgatttttgtttcgcttcgataatacaagtggcctgagctaagccagcaataatccgattgcgttccacaaagtgatgacgtagcggtcgcactccctgagcatactcactgagcagcagcccggtttgttggacctggtcttgtaaaatcgcgttttgcttaggataagtaacgtctaagccgttaccaattaccgcaattgttttcccggctccgtccacggtagcttggtgagtcatcgcatcaacaccacgcgccaaaccgctaacggtaactaactggtgctcaagcaaccctggaaccagttttttaaccgtcaccattccgtaacgggtcatgtttcgagcaccgacaatcgcaaccattcgcggttcttggagtaaatctagtcggccccggtaaaacaatacggtgggcggacaataaatctcacgtaaaaggtcgggatatgctggatccgcaatcgttaggattcccacgttttgctcattttcatgaatcttacgctttaattccgaactatgcaaatagttaactaaatcacttcgctgttcgtcggaaattaacgggcttgtatgtacccattcagataacgatggctctagctggtcgcagaccgcttgataaatttgagattgctttttaatgctaaaagtagtgccgattttaatgcgaattaaaaaatcacgaagttccattctttcacctcgaatgtacaatacgtgattttaataaataatattttattgtcgaacaaattccggaaccggttcaaaagttaaccgatgtagcggggtaactcccaatacctttaacccttccagatgctgcttagtgccgtaacccacgttttggtcgaagccatagccgggataaattttattgtacgagcgcatgaggtggtcccggtagactttggccacaattgaagctgccgcaatgctaatactcttagcatcccctttatacatcaccgtcttagggatgcttgtaggaacctgaactgcatcaattaacaagtgttccggcgttacgtttaaatggctaatcgcgtcgttcatcgccgctttggtggcgttcaaaattcccatttgatcaatttgctggttagaacgcaccccgataccaacgctaactgcttcagatagaatttgggcgtacagagattccctaagctttaaggacaactgtttggagtcgttaactcctaccaaatcaaaacggtcgtctaagactactgccgccgtcaccactggtccagctaaacatccgcggcctacttcatcaatcccagctacaaactgtttgccggactgccataactcattttccaaggaaaaccgcttttgaaaggcgaggcgttgttcagccactttttggagcgccttttccttttgccgtaatagtttttgcactccggcacggctatcgtcagctagagccaaaaagtaaggatcattaacgttttgaacggttactaagcgttccttaatttctttaatcgtcgccacggtcgttaagctcctctacaaaatctaagttaaaacgacctaatttaccctttcgagcatccaacaagattcgttggctagcacgatcatagtcgtctcgcattcctaacttctgggtgattaacagtaaaagttctggcaaaggctgatcaaagtcttcatccgttaaatgataccgctccattaaaccgttacggtatttttcactaaaaatctgcaagccaaataatgccacatcatcattggcgtagaggttgtccttaattgccccagtaaatgctaacttactgccaaccgactggtcttcaaacttcggccataaaattccgggggtatctaataggtacaaaccttgccgtgatttaagccactgttgttttttagtaacgccaggacggtccccagtaatggcaacttttttgttaaccagatgatttagtaaggtcgattttcctacattaggaattccgatacacatcgatttaatctcagttttcttaattcctcgactttcccagttttcaagcttatctgctagaattgcgcgggtatgttttaagatgattttttccgttgaaggctctttagagttcaacgccacggcatggtcgccatttttgcggaagtactccaaccaccgttgggtctcttgaggatcggccaagtccgccttggttaaaattaataaatgcggcttatctttaataaccgactcaatcatcggattgcgtgacgaaactgggatccgcgcgtcgaccagttcgaaaacaacgtcaacgagctttaatttttcctcaacttgccgaatggctttggccatgtggcccggataccattgtataataggcatattctctaactccttttatatcaaggctttaaacaccttgtttgtttaaaattaagctaatccacttaaacttgctgattagcattgcttaaattagtaaaacgttattatatcagctacttttaccacgcttaaaaacattaatacggtcactgtataataggtatattttctaaccccttttatatcaaggtactgaaccctaattttcattcaatatctttgaaaattgggcaaatttatctaaaaaaataaactaactctttaatggatccatgagtcatcggattgataataatttttttagcatcaagtacttatgttacctaatttattcaaattttcaaatctgaatatccattgaggatgtattaattgaaattgggcaaattcaaaatctagtaatcgccaaatcaattttaccatcttcaaagctgtttgctaccacatcttgagtatccgtatcgtttctaataacgagcattgggcaaattaagtaagtcgaaaataagctgtttacacgatgttcaatatttaattagcagttaactaatttttactagcccttaataaaataaaaaacagaaatcaattcctcgaaaatttggtttctgtttttgtgtgcatcaaatctattcataaagatccatacatacactaggacaaacaaaaagagaaccaaactctttctctttcactcgtaaaattgatttttttctatctcaaacggtttttatcaccaaattcatccttcattgccatacaaaatacgtaaatggaaaagaataacattacgaaaaatgatccaactacaaaatctgcgctttccttaagtggtgtaaacgaagtcattactaacattaatgagttagcaattatccaaacaatatacagccttttagttcgtttcgttaggtttgccttttttaatttcatgatgaatcactctttttacttcacacatgctaactattccaacatttcttaattcacaaagccccttttaacaattgttattgaaacttctattaggttcaaatattcactgaattctgaattttaaaatttgtcatttatcctacccatacttatatagtacattcttgaattaaaaaccgttcctacttttccgctttaattgtaatctttcttcatgcgtttgcaagcgttttttattcctgaatgtacggcttcgtattttaagaaaaactgcttaacatttagcaagtatactttttacaattttttgaattttactcaaaactaaaaaaggaaaacaatacgttgttagacgaaatgatttccttaacaggttctactattacctgtcttggcaaaaagccaatatatgtatcagcaatttttattcaaatatagtgcttccttctgttaaacgtacaaagatttcgtaacttattggtatactccctatccgaatattattctgaacagaatacatactatttgtatttatatccaatacatttaccgatcgaattagtttagcattgtttacgaaatataaatggtcaacttaaatgtataattgggcaaaacctacaaatatttgctcattatggctataaattattttaaaaatcaaatttctgcttcacttgataataaataaaaaagccctatataaagggcttcctgctaattaggtttactattttatccttttttaaaagcgctaatgtaattgaagaaacaatctaccattaccatttcacactgtaaaatctatcttttaattgtgcgacattctctattcttttatttatatcaggatttgtacctgcatcaataaaatcttctattgtcgaatttattccttttctattactaatattttctcgacccatcattacaaagtaaatgagacatgtcatagcataaatctcgtgctttaaagaataattactaaatccaactcttttcaaatcaggatcattgatattaattgatcctttaatggaactgtcgattgacgtcagcgttgaatacgacgtggattttgatagtccaaaatctgaaagcttggctacaacaattccttcatatttttttaacaatacgttacataaacttatatctctatgcagttgccctttgctatgaacatattcaatactcctaatgaactgtttacatattgaatagcgtgtccttttaggcaaattaggatgcttttttataaaatgatataaatcatactccaaatattccatcgtatattctaatatattcgcagtctcagttaatttatacacttcgacaatgtaaggagaattacaacttgataaaaatttaaattcatttttaaatcgttgacgttctttttcatttagttcttttttagcccttttcaaaacaaaaaacttaccatattcaggatccttatatttatacgtaatagcgtacgacccttctcctatctgtcttaggcgtccactttttgtgtgattacctctctgcaagctaattatatctttactttcaaagataggtgtagtaagcggcaattccatttttggagtgttactaggtatttcactcccgccactttttatcataaaactatcaaactgctttaccgcattagaccacttttgggtaagcgttatttctatagaatgtccctttgagttttcttcaatttggtgaattttgtctaaaacactaataaaatccctactttcagacgcgtgaaaatgctttgaaaaatctctagttggcaagtatgcatttaatgttcttaattgagttacaaaaagtgcgtgtatagaagataaaattatgtctaattcatcatttttaaataactcatatactttaacgtagccttcgtttatacttttttcgttttttagctcttcataaattgtcataatccaatcttgattatcatccatcgtaaattcgtccttcgttaaaatttcagctctccattacacgttacaacttatatatttatcatactagaaatttgatagcaaattggtcaaattatgaatttttatttaaaaactcggttcactaatttagaaatgaccttagtttgtttttctttatacaatataatttagtaattatttgagcaaattatcgtgcgttcctagattcaagagatataattctaatgcttatcgaaaacgaactaataaaaatggattcactaggacctttaaggaatatgttgctgaaaaatacgatgttgaccacaaactaatatcaaaatcactgactccaaagggatatacagaaaaaacttgattaatgaagattgggaatattctaaagcaaaaaagaacgaaaaatcggatttttgatttttcgtcctttttatttattgtgagaggcatttttgtcacaacctcattttacttcacttatttttacttggtagttgttttaagaactaatgactctggtgtaacttgtgcattacccttgaacttcatcacccgaactgcatccatgttcgtaacgatgacgatcattggtgtttgcttacccgcatttttaattgcgtctaagttaactttagctacgacgtcaccatgtttaaccatttgtccgtcttccaccttaacatcgaatggagcaccatttaattctacagtgtcgattcccatatgaagaagaacttctaaaccggcatttgttttgaaaccaattgcatgtttagttggaaatactgatgtgattgttccatcaactggagcagtaatagttccatcaataggattaatagcatatccgtcacctaacatcttttgagcaaacgtgtcatcaggaatttcctcaatgtccatgtattgtccattagcaacactatagaactcttctgtaacatcccgtttaataccatcagcaaccgtttcttctgttggagctggttcatctgcagtcttcactgaagaaattggggccttagcattgtttaattttgcaagtgcatctgaaacaaattgaacttcagtaccaataataatttgtaggttatttttatcaatcttgtttaatcctgcagcaccactacgtttgattgcattttcattaatattatctgtgtcattcaatttaagacgaagacgtgttgtacagttatccacaacttgtaagttgtctgaaccgcctaaagcagcataaatcttcttagcttgaacagtatacttatcatctgaatcatcagttgcaacttcttcaacaccgtcatcttcacctagttcttcgcgacctggggtcatcaaatggaatttcttaatcgcaaaatcgaaaccaaaatagtaaattgcagccattacaaggccttgaacaattaaccatagtggttgattagcgataggattcttcaaactaagcacataatcaactaaacctgcactgaatgcgaatccagctgtccaatgcataaatgccgcaaatgcaagtgatagaccagtaaagatagcatgcaatacgtatagaggccacgcaacgaacataaatgagaattcaagtggttccgtaacaccggtgaagaatgaagcaaacgcagcagctaacatcaatgatgctgtagttgctttattttcaggacgagcatttttgtaaatagcataagctccggctggaagtccaaacatcatgattgggaagaatccagcttgatacatacctgtaacaccctttgtaccttgggaagccaagaatttaccaatatcgttaatcccagccacgtcaaaccagaatacggaattcaaagcttgatgtaaaccagttgggataagaagacggttgaagaaaccgtacaatccagcaccaacccatcctaagtttaagataaacttagcgaatgtaacgagtgcaccgtaaactggtggccaaacaaatagtaatactacactgacaagtagcataacaagggcagccataattggtaccaaacgcttaccactaaagaaggaaagggccatcggtaattttgtttcgtggaatcgattgtataatgctgcagcaatcaaaccagcaataattccgataaatacattaccaatttgagcaaacgaagcatcaacggctgtaggtttgatattcattaatgtagcaaccgattcaggttttaatacattaaccggtagctcaaaggcaactaacccagcaagggcagcagccccagattgatcgactgacatcccgagggctaagccaacggcgaataacagtggtagttgacctaaaactgcgtcaccaccagcttgtaagaaatgagcaactacgtcattactgtaagaagcccaccagttaccaataccaaccaacaaagcggcggcaggtaaaacggctacgggaagttgtaaagaacgacccatgcgttgcaaatatgctttcatgaaaatacctccaaatagaatattgaataaatgcaataattcaattctatgttagtgaaaacgctgtttcaagcgtaaattattggtataatccgctttatgggtcttttttataaaaaaacaaaattggtatatacctattattagtttttgaaagcgctgttttgataaaaaattacatatttgaatttaccgtggtctaaaggactaaatttttttaaaaaattattggttacaacctccgtagaccgcttttttggacagcaactaaatcctcgtatcactactctctatctattgtttgctcaatatggctagaaatcattctaaaatttaatttgctattcgaaaacacactaaaaagaagccctatataaagggcttcctgctaattagacttactattttatcctttttaaaggcgttaatataatcgaagaaacaacctactttagaagcgtgcataacctaaagcatgttgcgcagccaaattaattaaactccattgccggtcgtaaccaggttggaagaagaagtcagcttcggctagatcttcaagcgtcaaacgatgttctaccgctaaagccaaaacatttccttgagcagtcaaatcgcatgttgaaagaactgctccgcctaaaacaatgtgggtatgagggtcaaatgtgatatcaacatccacgcgaacattgccctctgactcaggaacgtatgctggacggatgtggtcaacatagtgtgaattaacaatttcaacattggagcgttctgcagtaaattcatttacacccgtagaagcaaagtgttcgtcaaatacatgcaatgctgatgagccaactacgcctttaaagatttgggttggtttcttctcaaaaatatggtttacaacgtattgggcttcacgccgggcagttgtagctaaagcaattggggatggttttccagccgggatagataatggtaagatggcatctccgactgcaaatacgtcgggcacgttagttctcaagtagccatccacattgatgaatccacgatcagtcaaatccactacgcccttgagccattctgtattaggctgtaccccggcagcttgaattacaagatctgcaggataactacccttcttagtttccacactggcaacttttccgtcgcccttaaatgaggtaatgctctggctcatttctacttggacgccgttgtcagtcaacgttttatcgataatttcagtcatttcagggttgagataattgccgaggggacgatcgataaaatcaaataaagtgacgtgtttacctttcttagcaaatacttcagctgcttcaatcccgatgtatcctgaaccaaccaccgcaacatttttaatactatcatcagttaatgctgccttaatctttgtagcccagtcgtaacctcgcattaaatatacattttcaaggtctgtacctgggactggcaaattcttaggcgtcactcctgaactaagaatcaatttatcataagcaacttgttcttctgtaccttcttttaaatccttaacggttacctgtttttggtcaacatcaattgccgtaacttggtgattgttataaatctttccgcccttggaagtgatgtcttctggtcggaaattccttacgtcattaacatccgtaacttggtcttctaagtaaagttgcatcccacaggacatgaacgatacgaaatcacccatttcataaatcgtaacatcgacgttatcgtatttatctaacagctcaattgccgattcatgtccgccatgtgatgccccaacaataataacttttgctttatccatctataatatccccctattcataatattacagctatagtgtaactctttttgtaaaccgcttacaagcaaaacgacagtaattttacaaaaactatactttattgcattaaatgtatttgtttaaataaaagtattaagtacttaacgttagataagttagagcttaaatagaagtaaccaacaaatttcctaataaaaaagccacccattttaataatcaaacggcttcaattattgtacctacgcccataccaccaccaacgcaaaggctagcaaggcctctctttaatttttgatcgtgtaactcgtatatcaaactcactaatattcttgctcccgaagcgcctactgggtgtcccaaagcaatcgcaccaccattaatattcacgttctctgtttttaactttaattttctaatacatgcaatcgattgcgctgcaaaagcttcgttaagctcatataaatcaacgtcttctttcgctaatcctgcattttttaaaacttcattaacagcatagtacggccccatgcccatcatgtctggacttaaacctatcagagaacaattcacccaccttgctaagggctttaatccgtgtgcgataactgcttctttagaagcaaggattagcgctgcagccccatcgttaatcccagaagaattgccggcagtaacctccccatctaacttaaacgctggttttaaatttcccaatttttcaatggttgtgtcctttcgtggagcctcatctttgttaaataaatatttgccatccgcttgatttacggttattgttgtaatttctttatcaaagcgaccgttattttgcgcagcaactgccttccagtgactagctaaagcaaactcatccatttcacgtctgctaacatggtatttcgaggcaacattttcagcggtaatccccatatgatagtggccccaggcgtcagttagcgcatcacttagaattgcatcttctagaatttgattaccaaggcgctgtccaaatctcgatttacgcgaaattaaaggcgctaccgacatgctttccattcctccggcaattacgacttttgcctgttttgaagcgataaggcttgcagctaaattgatactagatagaccagatccacacacatcgttaacagtaatggccggtacagaataattaatgcctgcggataccgctgcttgccttgctgggttttgaccattacctgcttgaatcacattccccataagtacttgatcaacgtaattatcctctaaattagcttgttccattgccgcctttattgcaaatccgcctaattcagcgcctgtaaattcttttagacttccacctagtttgccaattgctgtccgtttggctgcaactatataaatttcatccaatccttgttcaccccatgtatcttactaaatgccattttatttaaaagaaacggcacaactgctcgttactatgcaaaaaatttattgacactcttcatcaagagtatctgagcgctttcaaaactcgttctctcgtttattcttaagcattaatgttatcacttgttatatttctttacatatactatttatacatcaggcaaaatcattacgtttttttataaaatgtgttctccgctttgcccaatttctaaagcgttttacccaaaaatcctccatattcgataaactaaaatatgctaaaatcacattagaaaaagaatttataggaaaaatagcgtataaatgctcagacatcacgcgaaagtccgtcaacgatggttatttggcaacgaacggatttatctaaaatatgctatatcatttaagtgaatggagaattttatgagtagtgaaaaaattgaatggcggaaggaagaaaaaggcttttcccttaggaaaaagcctcaaatattaaccattcccgaacaaaattattttagtattgccggcgaaggtgatcctaatttacctgattttcagaaaagggttcaatccctgtatcctgtttcttatgctattcggatgagtcaaaagaaaggctgggatatccctaactttaagctatatacggtgtatccactccaaggatactggggaattcaagaccaatatttaaatgctccggtaatgaaaaaagaacactttaaatacattatcagcattaaacaaccaagttttgtaactgacgagattgctaaagaagctctagaacgtgctaaacctaagattgatgcttccctgtttgaacaaatctacttcgagcatcgtccagcacaactggtcgcccaaatcgtacacgttggctcatttgatactgaacccgaaagttttcaaaaattagagcaatttattgatgaagctggttatcaacgtagtgaaaaagaacatacggaaatctatatgagcgatttccgccgggttgaagaagctaagcgcaaaactattttacgggtggctattcaggagaaacagtaattagttaaggtgatggtttgcttgttggttctgcgaatatagtcaagtatgcccaatttttcaagtaaggtatctattttttcgaatgaaaagaccttgaggattttatttcaatctttaaggtcttttttgttttttagctaaaacactagatatccattcttaaccaccaaattttgtgtaaacacaaagctttgtaaccattctttatgtttcccaccgcttaaaccaactaatcccacccgccaaaaataataggctagtgactaggctggctactattccaattacccctgtttgttctgctaaaccgataacatggttcctaaaatttttgtctaccaaattaactacaaatacatttgtaatctcagacaaccgataagcatacgtccaaggaattaaataccaaattttctcaccaagattggttgttccaataagggttgataataaaaagccgaaaatactcacgctaattgaaattcctaaatcccatctaaaacttatccagatttgtagggcaaccaccggcagagttccaatcactccaagagccactcccataagtaatattcttaatggaatcgcatttgctagcccaaaagtacctaaccaaaagatccccgtagataacagaatactaactaaaaagcataaacataaaaagatatacttcgttaaaaagattttcttcctggaaatttggtcagcgaataaagcggaaaattgttttatttcagcttctttatggatatctagtcctaccaaaacacctataaataacggcataatcaaagatagccatatattgaaccatgtgttaataagatttattcgtacaatccctttatgcgtccaaatataaagtaacgtaaaaaacgcaagcaaaatcggaaatgcgataaccatccaccgaatgccagtccttttaattttaagccactctgcactaatgaaattcatttgaggatactctcctttttaaaaatcgcggcacttccaaaagtaagcactacaaataatcctaccgctagtgaaacaccaaccgggaccactgaagtatttagaagtgcatctccagccatcagttttgttccgttcggatgtactccaatcaagggactcaatactcgaataccccaggtccaagggtcaaaaagccaaaaacttctggctgcaaaatacatcccgctaaaagcacccataatagctacagaaaaattcaataagtgtccccataagtaatctaatattagatgcaacggtaacaagggaagtaaacatacccaacaaaacaaatcatcccggactaaatccacaattggaatgggaccgcccacaagcattattccaattatcgtaagaccaattgccaaacaaaggttaggaattatcatatagattgcgaaaacaataatcttattaatccataatttttgaggaacaatattatgaattaattgcgcttcaaaattcctcccctcattttctgtattaataatcatcattgctaataatgcaatactgattggcaaaaatactgccggccaccaattaaaaataagtccgaatagcttatcccaagtaaaggtgttattatgtgccgcaattgcctctttcgtgttagccgatattatggcaatcattactgttaggatcaatggcagaattgggattaggaaaaacatctttttcagaaaagtccgcctatactttaatatttcgaccgcaatactattcataacgttcacccttagttaacacaatcttagtaaagaaatcttccaagctttctttttgatctggtacgccttcaaacaacaattcccccctattaatgataccaattcggtcgattacttgagctacttcagataaaatatggctagaaagaatcaccgtaatcccttgtttagggaaacctgcgattaagtcccgcagttctttaaccccgaaagggtctaacccgttggttggttcgtctaaaataagcaatttcgggttattcagcaaagccagtgcaattcctaatcgctgtttcattcccattgagaacttacccgccgtctttttgccagtcttttttagatcaactatttctaagacttcactaattctgctaacaggtatgttcaataatttagcgtggactaataaattttcctcggcagttaaattattatataaagcgggcccttcaatcagcgcaccgatgttatctagatcttttctagatatcggatgtccatcaaagataatattcccttcggtaggcgctagtagctgaacaatcatttttaataacgtagatttgcccgctccgttaggtcctatcagaccatataccgtattccttttaatgtgcagtgagatatcattatcagctaattcatttttgaattttttggataaatgacgagtttctaagattaaatcttccaaacgtaatccctccctggatgccattgtttatggcatttgttccaaccattgataaataactaaatcgcaatcgttgcctttcattccttagatcttcctttatagaaatcgatttcaaaaatacggctgtccacggcatctaaccactcgatcgataaggattgaaaggttctactttatgtaaaatgcaggaagtaacattaactttcacgcattttaattaacttaatgcatcctattgaattcaaaacttttttaggtaaaatggggaccatcgtcattctgcatttcgcgaaacttacatttcaaatctactaataaactttcaacttttgatttcacctaaaggatagcactcgattaccttttaaaatgcattctgaatattctttaaagtttcttagctttaccatttcacctaactactaacacgcgcagctaaatgattagccagccctaatctcattggttagcatctaaaattgcccctccctgaatttttaaaaaacaaaaaaggaaaccacttcgtcgttaaacgaaatgatttccttaatagccactacttactaatagcgtggcttttgaatgtgcaaaacgctaaaatcagactatttggcttcgatgacgatttgatcatcaaccaaatcagctttcaagttcttcacatctaaatgatcaagatagaaatcagtaaccttgtctcgaatttgttgttcgatcactcttcttaatggacgagcgcccattgcttcatcgtaaccttgttccattaaccaatccttggctggtttagttacttccaaagtcaaatctttcttcgccaacgtcttttgaacatccgcaatcattagatcaacgatttgacttaagtctttcttagttaagtgtgagaattctacgatgccgttgaaccggtttaaaaattctggccggaagaatggcgcaagtcgatccattagggattgatccttagcatcgtcgccagttaatttttcgttaccgaatccagcgtttgatgttgcaataataattgtgttcttgaagttgattacgtttccttgaccgtccgttaaacgtccgtcatccattacttgaagtaaaagtgttaggacttggggatccgctttttcaatttcatctaataaaacaattgaatatgggttccgccgtacacgttcggttagggtatttgagttatcatcgtatcctacataaccagctgacgtaccaattaatttggaaaccgccgtccggtccgaatattcactcatgtccaaccgaataatcgcattcttattgccaaacatatctaaagccaactgtttagctaattcagttttaccaaccccggtcgggccgacgaataggaagctgccaattggttgttcaccttcggagaatccagcccggttccgccgaattgcccgagcaaccatttctaccgcttcgtcttgaccgatgaccttgctcttcaaacgactatctaaatcttttagccgttcaatatcgttagcacccatgtcagaaactggaattccggttaaccgttctaccgattgagcaacgtcgtccaccgttgcgacgacttcttcttttttatctgcattcttaatttgcttgttggtttcttcgatgcgttgctttaagtcagcggcacgtttgaaatcttcttctttaacagcctgttccttttctttttcaagcttattgagcttctcgtttagagttgcttgatcactttcaggctgccgagctgccaagtgggcggcggtcatatcgattaagtcaatcgctttatctggtagagttctttgtggaatgtactgaaccgaataatccaccgctgccttcaaaacatcatcggggagttttacgtgatgatgtttttcgtataagtctttaacaccttgcaaaattttaaacgtgtcttccgcgcttggctcattgaccactacgtcgttaaaccgacgagctaatgctgcgtttttcaaaattgtattacggtattcgtcttgggtagttgccccaatgacggttaattcaccacgggacaatgctggcttaataatatctgccatccctttgccaccatcttcgccgccggttgaacccgcgccaataatttggtgaatttcgtcaaagaataggataatatttccagctgccttaacttctttgactaagtctttgatgttttcttcaaacgacccccggtattgggttcctgcttctagagaggataaatcgattgaataaatttctttgccttgaatagcttccggaacgttaccatttacaattgcttgtgctaaaccttcgacaattgcagttttaccgactccggcgtccccaactaaaatagggttattctttgttctccggctcaaaatttccgccgtttcttgaatttcattttcacgtccaataactggatctagcagaccatcgcgggcttgttcagtcaagttagttcctaacttctccaaaataccaccctttttaagggcctgttgtccgtccttggatacttcgattgtttttgcattttctggtagtttaccagttgctcgatattgagcaaactcatctggtgttaacgactgcccattgaccaagtaacgagcggaatccgagttaggatttcccatccgtttgaatacttgattaaaaatatcatccatatcattgttgaaaaaaggatcatttccgtaaaaattggccatgtaacaacacctccgttaattaaatgaagtaaaaatcgtgttgcaatattaattagaagcactcttttcacctacaactatagtatacacccttcttagcactctgttaagtaaaatgctaactcgattaccctgtataatatttatgggcgtgaaataccatattagcgggatttcccggttttaaaagttttccgtaaggattaaatattgcgccttgatatctaaatttaaacattttggatccttaaatttcacttccgtacagcaagtcgaaatccattggcaaatctagaaatatctccagcctgccactaacttttacaatcgatagccattaaaaatttggttcggaaataaaaaaggaaaccactcgccactagacgaaatgatttccttttagttattgaacatttttagcaacttactcatgcagctgttttaaagctgctttagggacatcctttttagcaaccttttcccaagaaatcacttggtgccgcttggtgttatatccaacctttaaatatgcatgtagttttaagggccgtcctagcccgcctctaaacttagccattactttttggccattttgatcatagattggttgatgatacatgtaatccacgacttggctacccgagtcatctttttcaacaattttggttccctgattagtgatttgagtgtaataattttcggtaccgtagttggacttataccagaaataagcacccccgttatgctcaacaacataacttagtctgataaagcgggattcgcaaatgagcactattttcccaaccaccgctccttaaaatttttcaaacttctttccaagagtaaaacctgctcgtcttcatcagctagtcgagcttttaatttatctaagagttggtttccaatttttaggtactctcctggttcgggttcatattttaatttaaaaaaagattgaatcgcctcacgatattttttcttctcaagatactgctctatttcggctaaaaacttattcttttgctgattttcttgctgaaaaaccacctcgatatctccgttccttttctttccaagcacatatcccagtccttcggcaaacgacttcacctgtttcataataaaatctttatcgttatccaaaatgcctctcttaattttagtgtgcaatttcacttgaagtctaacaccaatcctgagccaaaaactagggtgcattattctttatagtttcttaagttcataatttttaaccgttgggtttggtaccttccttacaaaacttatctttttcaccgaatcactaaaattaacctctcccctgttcatggctgggctttcctaacgttaaaaagaccatgctaaattaacagctaggttagcaactaaccttcaaattcaaccaatccggtaagaaaatctttttataccgtagcaagcgcaacctataccaatttgatttatacctacaaatacgttaacattttccttatcaatcaaaaattaaggagcgtattttttattaaaaaactaaatctttttcagctagtaatgctcggacttggttctctaattggttccgggtggcttttcggatcaatggaggctgcttcggtggcaggcccggcagcaatattttcttggataattgggtttatcgtgattgctgtgattgcctacaactatatcgaactaggcaccatgtttcccgaatccggaggaatgagtaaatttgcccaatacagccacggttcgctggtgggcttcattgcctcttgggccaactggatttctttaattaccttaattcccattgaagccgttgcctcggtccaatacatgagtacctggccgtgggcttgggctaattggacccatcactttttcaaaaatgggaccatcacgactagtggtttgttagtagtattttgtttcattttaatctttaccctcttaaattactggtcggtatctttattaactaggtttacaagtttaatttcaatctttaaaattgccgtgcccttaatcaccatcatctttttaacgttaagcggttttcatccagaaaattacggccattctttaactgagtttatgccgtacggatcggcttcaatctttgctgccacctcggcttctggaattattttttccttcaatgcctttcagacggtaattaatatgggtaatgaagttaagaaccctaaaagaaacgttggcttgggtgtggggatctcccttttgattagtgccgtactttacttagttttacaaagcacctacattacttcaattccaagttcattgatcgctcaatcaggttggcacgggattaattttgaatctcccttcgccgatttagcaatcctcttagggatccactggttgtccgtcctactttacctggacgccttcatttcaccatttggtaccggagtttccttcgttgcttccacgggacgggccttagccgccatgtcaagtaataaccattttcctaaaattttagggaagatcaatgctaagtatggaattccacggatcgcaatggccttcaatgccgttttaagtatggtaatggtttcgatttttaggtcatggggtactttagcaagtgtcatctcaacttcaaccttaatcgcttacctaacgggcccgattacggtggtttcgttaagaaagatggcctcgcgtttcaaccggcccgtccggttaaaagcaattaaattcatggctccgttagccttcatcttagcttccttagctatttactgggcaatgtggcccactacggtagaagttatcctagttattttacttggcttaccaattttcatatattacgagtggcgtttacattggaaagaaactattaaccagttgcgtagtagtctttggctaattgtgtatctaatttttctttcaatcatgtcctacattggtagcgccgattttaacggtaaaaacttaattcactaccccttcgactttattgtgatcattatagcggcgttcattttctacgtatggggaatgcgtagccgaattattaccgtctcatttggcaatgcccgcgaagttaataatcgcgtcaaaaaataaactaactaatgtaaaaataaggggctgtgacaaaagtctctaaacaaaaaaaacgattcatgaggtgaaacttcctcatgaatcgtttttattttgtttttttgacttcaattgagccaaaagtcagttggttccgcttaaccaaaaaattgatcatcatgccaaattcaggcatcatggtcaattttcagttaatgctcgcaaactaccggttcttgttccgttctcttttacgtaggaacaaattagtaggcaccgaattgttagattacttttctaaactagcttttattccaccttggataaaattttttcttagactaaagccagttttcttcatataccgcggtattaaagccgcaagtaaccttagtatcgtcaaccattagtgggcgcttaatcaatttgccattctgcgacattaattctgctgcttgttcctttgacatcgtatctaccttatctttaagtttcatcttacgatagtccattccactggtattgaaaaaatagcgtaaattctgatcacttttagcaaaaaaatccagcatttgcgccttagttggcggctgttcaaccaggtcaatttttttatacgaaacttgctgctcttttagccatttttcggcctttttacacgtactacacttagaataacaataaaatgtggtcatagtagcctcctaagtcatatctaaactttaatttatgatactacattttttagctaaagaaccagactccatccgctttttatttagagattcactattattttgaaaattccgtattaaaaaagggttcgccaacttaatgacgagaccctaattacttttactaaattgaagttcatgttaaaagttttgattcatacttatttttgcttagcaagcacttgttctgctttatttaacgcggggtcactcttcgaaagtgcgttaattaccgcttgttcaatagaacgcatggtcttcgcgtcagtttttccggtaaccgttagatgattagcttgttggtaagcttgcaccgcttgcgcaacgctttccgtgtaatctttagtaactttgccagaataataacccaaatctttcaacgcaatttgtagattcttaatatcggtaccgctttgccccacttggtacgtttgatggtggttaaacgtggtgatgtaggccatttcaggatagtcggctttgtaatctggcgttagtccttttttattgatccaggttccatccggcgttaaccacttagcaatcgttagcttaagttcgtcattatccgtgtactgggtaatattttgtacggttcccttgccgtagctttgtgcgcccaccaacggaatcctcgctgattgatgcaaagcagccgcaaaaatttcggcagcgctggcactttcgccattaataattaccacggccggtttcttaactttgtagcccctgtctaacttatggctagccttataaacttcaggcttaccactccgggttttgacctgcataattggctggtcatcttttaagaacattgaagacatcttcaacgcctgttgcatcaagccccccggattattacgcacgtcgatgatgtatgatttagccccttgatgatctagcttcttcaagttcttctttagttcactcgccgtcttctctgctacagaagaaatcgtgatgtatcccaccttattcttcaatagcttcccggtcaccgtttcgaccggaattttggcgcgcttaagctttttagtaaaggtggtgtctccgcgctgtagttccaattccaccgtggttcccaccttaccacgcataatgctcatcgttttgggcaacgactgactagcaactgatttaccgttaaccttaataatctgatcgccggccttcagcttcgctttttgtgcgggagttccgtcaatcgtggacatgatttcgatatgaccattctttttaattacttggatcccaattccgccaaacgatcccgccacgctatcatttaaggaggaagcgtcgctatcggtaaggtagtttgaaaacggatcgtctaaggttgccaacatcccgttaattgccccggtagctaacttgttagaatcaacgttccggtaataattagcatcaatttgattataaacgctcgcaattcgatttaaattggtttggcggtctgctgatgaattagtgaaacccagtagaaaagtcattacccccgccaaggtaataacactccctaaaattaccgacccaaccacggtaaggtacgggtgtcgattaataaattttttcattaattctgttcactttccaagtatcgttgccaagcctgatcaaaaatggtcatgttttgcaaatagctcccgttgagctctagatacttactgatttcttcaaaatcccggtcttgtttaggaaatgattggtcgaaaaaagcttggtttgcaaactcttcaacttcgtcattaggttccggattccgttgggtcattaaaaactggtaaaatgtttttctcaaaatattcctcctctacttcacgacaactcggctagtttgctgatttaggcacgttgataatgaatttaaactggtcgtgtacaatatcaatcttttcaacttggaaactaactttatttgtggttttgatctggtctaaacgtagcagtgcttgatccccattaataattacccatttaggtaattcatagttgcgggaaatatatttcaaaaccaccttagctggcaattttaacgttcccactgacaagctgtgtgctttaagccgaatattgccccccttagtaactgaaggcaccatcgttaacgcaaattgaactttttgccctaggacttcaatttggccgcctaaaatcgcgtaacgttttccaattctaaattggtaggtaaagtctttgcttttttgaaactggttcaaataggccgcacttaagtcatttaactgcgttttattcaacgtgattggtacttggtcaaacttatggggatccttcttagctgttttttcaaactgggggaccggtaagctcgctttgaagcccacgtaaacactccccgccaataataacgctaccagagttaaaaatccccatttccaaaaattatataaatacttgttcattccgccctcctaatcaaaaacttccaatttttgcaaagcggattttattttacttgtcatcatatcataccccttgtcatttgggtgaaaatgatcttcatttgaaaggtatgcgttcttttctttactgtccactttccgagcttccacccgactcttttccactaccgcaatgtcatcttcggtactttgtttctttaattttttgatttgttgtttagtaataaactgccctttggataaagcgttgatgttcacaaaagtagcgtcgtcaaattcatcagtcgtcgccttagcagttgtattaaaagtcgttaccgcttgggtaatgctagttacgttggggaagtacacgtaaaatggattataaatgcccaccatcacgatttttatcttaggattattcttccgggcaatttcaaaaattttccgtaaattattttgatattctaggctaactttattaacccgtactaaaatttgactttctgattcactaacgtttttttgtaagttctggaaaaggtcgttgcctcccgcagtaaccaccaaaacatcacttttagccgcttctttttgaatccgctttgtattttgcaaccggtgtaaaatttggtcactacgttcgccactaatcccttcatcataaacggttgctttacctgcaaggttcttttgcacaatttgcttttttagccgcttttggtacccatccctgtcctgagtgtctcccacaccctgggttagtgagtctcctagcgccagaatctttacttgcgacgttgcaggctgtggctgcttagctttgagcttcacgctctttttaacggcagttggggtaggatttggcgagtggctgggctgcgagcttttgaaaaaacccatggcccacaaaaaaaccgttgtgattaaaagcacccccacgatgctaaacacaatttcctttaaaacttttttcatttttcctcactcttaaaccaaattagggccaaaaccgcttattcgattttagccctaaaggttagtcttcactgtaatatagtaaacaaaatgcgcccatgccagtgtgggtagcaatgattggcaccgtttcacgaaccacaatatccttcacagggaaaagttcgccaacgtgcttcttcatatcttcaaccatttcatcagcatgcacatgtgaaatcccgactgacttaattttaccgctttgtttcatttcttcgtaaatatcaagccagatcttcttcatggccttcataccacgaactttgttagcaacgtctaatttaccatcttttacctgcaaaagcagcttgatatttaacaatccgccaagcattccactaaccttactaagtcggccacccttaactaagttttcaaggttaacgatacctaaataaagtttagtgtggtcgcgaatgtaggcagcacgttccagaatttcttctttggttgctccagcctgagccatcttagccgcttcaataacttgaaaggctagtgcccgatcggtaaactggctatccaccaccgtcacgtcggacttacttagttcagcagcttgttgcgcagtgtgtaccgtcccactaatggccgcaagcatattaaaactaatcacctggttaccatccgcacctaaccgatcaaacatctcaacgaatttacctagcggtggttggctagttttagggagtgaatttgactcggccatcttttgaataaattcttcgttagaaatggtctccctttccatgtatacggtgtcatcaatcatcacgctcaatggtacgattgaaatattatattttttgatttcttcatccgttacaccacaggatgaatcggtgacaattttaatttgagtcatatgcttccactttcccttgtatcataattattacgagccaaccaacgtcaattaacactttcaattaagttagtaaaactcgcttgcttaataatattattataacaatctctgttgatttttggctgaataatgccgttttttaataaaaaggttgggaaaaaactaataaaatgcttttcaaggatgaaaaggatcttaaaaagttgtcttggtgttttgacttcaatagagccaaaacgtgcgccaaaagtcagtttgttccgcttaaccaaaaattgaccatcatgcccaattcaggcatcatggtcaattttcagttaatgctcgcaaactacccgacttttgtcccactctctttcgtcatggcttttttatagttaatttcacccaaaattaattacgcttgacccattgctgaaaaacgtggtctggaactccaggtacactttttcccggacgttcttcctgtaaagtaaacttttgtttatccaccacgggagcaaatacgtcgcattgaaagtcgccagttactttagtgatcaataattcatccgcaaccggcattaacttatgatataccgctgacccaccaattacgaaatgcttttccgttttcgtaaggctagctaacaattcttcgtaagaagaaaacccccgaacttccgagggcaattgttccggatggtgagttagtaccagatttgttcgacgcggtaacggacggccaatcgactcaaaagtcttgcgacccataattaccgaatggtccagcgtagtttgtcggaaaaaagccatatcatccggtatatgccacgggatggattgctgccgaccaattccatgacggtcatcttccgcccaaatcattgtaatcatgtaaatctcctaatttcttaaacagctaccggagccttgatggtaggatgtggatcgtagccttctaccacaatgtcggctggttcgtaatcaaagatattttcgtgaacttggttaaacttcaaccgcggagccggacgagggtcccgagttaattgctccttaacttgggcaatatggttgctgtaaatgtgcgcgtctccaagagtatgcacaaattcaccaacttctagaccacaagttttagcaatcatcgccgttagcaatgcgtaactagcaatgttaaacggcaccccgaggaaaatatccccgctacgttggtaaagttgacaactcagcttgccatcagccacgtaaaattggaataacgagtgacacggtggcaaagcagccgttgggacatcctctggattccaagcggtcacgatcatccggcgagagtcaggatggttcttaatcaaatcaatcacgttttcaatttggtcaatagtttctccagtactggttttccaagcccgccattgactaccatatacattccccaaatcgccgtacttagcagcaaaggcgtcgtcttccaagatcaacttggtaaaacgatccttttgcacttgatactgtgcgttaaaatccggatcagtcaaggcgcggtgcccaaaattggtcatatctggcccatcgtattcggcgctctctacccattttttaaaggcccattcgtcccaaatgtggttcttgtgttgtaacaaatagcgaatattcgtatcacccttcaaaaaccacatcaactcgcttttaattaagccaaacggcacccgtttggtagtcagcaaggggaacccttcactgaggtcaaaccgcatttggtagccaaaggtactcaaggttcccgtttgtgtccggtcatttttttggtgaccattttctaagacgtatctttctaggttcaggtattgttcttcgagcatcccgttactccccttcttcaaaactttccaaatactcccagcgcgccattttattctctaactcatcggatacctggttgagttcagcctgaagttccgatagtttgccataatccgcagcgtattcgttcatttgttcggtaattgttttagatttttgttctagtttatcaatttctgcttcaattgtctgccattctttttcttcggcataggttctttttttcttcttttttggtttggctacgggagttgattccgtccggggcttagccgtggtagcgttagtggacgtggtttgcgcccgctgtttaaggtagtcgctaatttgaccagtgtattgtccaatctgcccgttaccatcaaaaatcaacaattgatcgctaaccttatcaaggaaatagcggtcgtgagaaaccgttaaaacggtcccgttgaaatgttcaaggtagttttctaatacggttaaagtggcaatgtctaagtcgttcgtcggttcgtctagtaataagacgttgggttgctgcatgagaaccttaattaagtacaaccggcgcttttcacctcccgaaagttttttaattaaacttccatgcataaactttggaaagagaaattgctctaataaactggtaacgctaattttttcaccgtcccggttaacaacttcttgaccaatttccttgatgtaattaattacccgtttgtcttctggaatgggctccatcttctgagtataatagccaattttaaccgtttcaccaatgtcaatcgtcccgccttgaatggggagctttccggcaatcgcgttcaagaaggaagatttacccgcaccattggccccggtaatcccaattcggtcgccagcttgaatcaacttggtaaagtcacgggcaatcgggtggtcccccacctgcaaatcaaggtgcttgatttcaataactttttttcctaatcgttgttggattagtccaatctcaacgtcttggtcaatttccttaggcgcatgcacgtcttgatcaagtttctcaaacttgttaattcgagcctgttgctttgttccccgggctttaggaccccgcttaatccattccagctcttgcttataaaacttgtacttcttttcttggctagcttcattttgctgttcgcgtaacgccttttgttccacgtatttagcataattaccttcatattcgtacaggtgaccgaagcttagttcccagatgtggttggttacccgatctaagaaataccggtcgtgggtaactagtaaaagggcgcccttgtaatcggctaaatacttttctaaccactcaattgagtcaaaatccaagtggttagtgggttcgtccagtagcaataaatccgcgggttctaataaagcctgcgctagcgcaattcgctttacctggccccctgatagttggttaattggggcatccagcatatccacgtggagttgcgttaggattgtcttgatattgctttcggtattccaggcgtccagccggttcatttcatcttccgctttggtaaacttctcaaaaatcgtacttgaagtgggattatcagtatattgagctaaaacttgctcgtaacgtttgatgacccgaaaaacttcttggtcaccgctataaataaaatctcgaaccgtttcatattggttaatctccgagctttgctttaagtaggcaatccggtaatcgttgggagcttcaaactcgccgctatcggccggatcaatcccagcgaccgcgtttaagagattggtttttcctgacccgttcgtcccgatcaacccaatccgatcattttcgttaatggtgaaattaatcgactgaaagagttgcttttccccatatgttttggttaaatttttagcctttaatgttttcattctcaatcatctttccctaattttcgtgctgctgtaaacaatgcttctggttggttcggtaattgatcgttaattaccatagtttttaaggagtttaaaatccgccccatttggggtcccggagtgacgatctggtttgcaatcaagtccttaccggtcaccgctaattctttaggtgatttgatttgtagcgtttggtaagtatccaaccatccccgtacgtcatggcctaaaatttgcgccacccggactgcgttagcaacattatcagcaccagcttcaaataaaatcatccgatccaccccggtactatccagcatgctaagtacccgaacggttgccgtaacgtggcggatcaattcgttagaggtcttccactgctttaaaaagcggttgatttgtgcgccacgtagctgcaacatccacgctaaaagcgcccaaacttggttttcgttttctaactggcttagcggataagccagtaattcctgcagtacggctcccttaccggctaatcctgggcagtattcattgagccgcgtggcaaccatatcagctagtccccggttagggttggttcctagcatcattttttgaaactctactagggttcgttccaccgagattttagccaacaaactgctattcattttaatggccgctaacgtttgcggttcgatcacaaaatctaattgactagcaaaccggactccgcgcatcattcgcaaagcatcttcgtgaaaacgcgccttagggtccccaaccgcgcgaattttatgctgtttaaggtcggttaaaccgtcaaaaacgtcaataacggttcgatcttcccgtaaggcaaaggcgttaatggtaaaatcgcgcctcattaagtcttcctttagtgaccggacaaacgtaacctgatcaggccgccgaaaatcttggtaaccactttccgttcgaaaagtggtgatttcgtaactatgttctccagttaaaaccattacggttccgtgttcgattcccgtatcaacggttcgtttaaaaatttgtttaatttcagcgggataagcactcgtcgcaatgtccacgtcgtgaatgggcttaccaagcaacgtatcccggacgctaccgcccacaaaataagcttcatatccagcttcttcgatttgttgtaacacgtttcgtgcttcttcaaactcttgtgacattttttctaactgcaccattctcacatccaatccacatttaatactaccagaaaccaccctgattttgaaaaggaagttccacttctatggtatgatatttgcaagtactgcataaggaataaggaggttgtttatgcaaaaagatgaatcaattcggttgttagatttcgtcatgattacgctaggctgttgtctgtacgggcttggccttgccgtggttaacatccccaatcacctcgcggagggtgggatcaccggggtaactctgatattgcgggccttgtttgggattgatcccgcgctttccacgctgttaatcaacgttcccttaattttaattggttaccgctttttgggtaagcgttccttaatttacacaatttttggaacattagcgctttcgttttggttgtacttttggcaacgcatccccattagcttggatattcatcacgacatgttcattgccgggattctcgccgggatcgccggtggtttcggaagcggggtcgtttaccgttttggtggaactaccggtggaaccgacgtcgttgcccgaattttggaaaaacgccgtggaattgcaatgggacacacccttttcgcgcttgatgcggttgtcttaaccatttcgctttgctacattgacgtcttgcacatgatgtacacgttactagctgcctacgttttctcccgcttagtttccctgacccaggtcggagcttacgccggccacggcttaatcattatcagtgatcaaaatgaagaaattgcagaagcccttatggacgagctcggtcgtggtgccagttacataaaaatgacgggcgcgtattccaataatcaacaccagatggtttattgcgtaatcggtcctaacgaactcaacttagctaaacgaattattgaacgcgtcgacccccgcgcgtttacttccgtaatcgacgttcacgaagccattggtgaaggattcacttacgattccgataaacaacctgaataatacaaaaaatgcagaagtcgccaattggcaatttctgcatttttattaccgctgcctaacctttaaaataccgttaaatcagaatatttcggagttaactcattaaaatcataggtagctaaatttttaatatcttctccatggaagaatgctgcgtgactacgagccaacatgaggttaatcttgtcggtgtcatcaaattgaactaaaataactggtttgccattttcaaatgcggcgccaatttcaaataccgttccaggatctgaaatcacttcttcatcttgcttagcataatcaagaattgcaaccaccacgtctgatttacgaacttgacgaacgtcagcttcaaatacgccaacttgccacttaaaagtaccaaacttttctgcttcgtattggtgatccattggaacgtagatgttatcaccgtcgatcgtcgaatttttctttaaaagttcttcaaccttccgtacccgttcaatttgtaaatcactgaagaaaggtgctgctaaatataccgaatttgccattcttccaatcactcctttagccttgtgtaataaaactataacatagctaagagcattttagagcaatgtttttaactccgcagtcgaaattttttccggaagattcttgtctagcgcatagaaaaactgaccggttgcgtttttaccaacgactccgtaaacggttcgttcgttaaaactagtgagtagtttaatttggtaatttttggcaatcacatttttcattaacgtttgttgttcattaaaacttgcgtcgttaaatttcgtaaagtccgccggttgttctgccgtaaattgatttttacgcataacctcgaccatctttttgttaaatttaggcgcccaatctttaatcttaaagttatcttgccaacgattaataaccctgcacctccaaatctgctaattcatcttgcatattcaaatcggttgggaccaatttgacatacttccgcgctacgtctaccgcctgttcaagttgaccattttctttactgaagtggtaccaatctagcaagaacggcgcagaatcagccaaatcattcgcagcagcactaaaatgcttctgtgctcccgcaaagtcttccgttttccactcggcaagcgccacgttccaatttaattgggcatccgtgatttcgtccgtcgcgtaatttaatgtttctgcgtaacgaccttgacgattataaaaatcggtgatccgaattatggccgcttgattatccggggccaattctacagctttttgtaggtacttctcaactaactcgtcatcatgggcgtgctcagccatttcagcagccagcaaatacaggtccgggttatattggtcagccgctaacccctcttgtgcagcggtcaagcccttatcccattcctcatcgcggcggtacgcatcaatcaagtatggatagacactgctgtacgatgagtccatgtcgacaactttttctaacaccgtctgcgcacgttgcacttcattaagctgcagataggtaattccctcctgcattaaaatatcgggagtcaagtcttcatcatgaatctgttcataataagcgattgccttttcaaacttgccagaagccgcataggaagccgctaaacgctcgacaatgttgatttggctcatcatagggatcccttgcttaatcagcctgaggtagtacgtgacggccttaggatagtcttgcattgtgtagtacaactcccctaaggctaattgaattgccggttcgtctggggcaagttgctcagcagttaagagttttctttccgaaacctcgtataattcttcagtttgataaaggtcggcttccaccatcaatgccgacacgtaaaattcagaatcttcaggaatcttttctaggttcgctagagcacgatcattttctccttggtccaccaaaatttcagcagccaataccggtaattcatgatcaccaggatatcgttcgatcaatttttcataaatccggagtgccttgccatcaaaccccaaagcatacaattccccagctaggttataaagggtctcgtcatcgtcttttctcaacgcccaaccgtataatcggttgaattcgtcaatttgtcccgattctaaggcatctaatgctcttttagagtaatttgcttcttcgttattcataatttttacaggcaaacaaaaagccagcataacagagctatgctgacccaagttcagaaatccgcttatttaacagcgtccttcaaagccttaccaggcttgaatgctggaactttgcttgctgcgatttcaatttctttaccagtttgtgggttgcgacccttacgagctgcacgattacgtacttcgaaagtaccgaaaccgatcaattgaactttgtcgcccttcttcaagtcatcttgaattgagccaaatacagcttcaacagccgctgttgcatccttcttggttaaaccagtcttcttagcaacattttcaactaattctgctttgtttgccatgtatatttcacctcctgaattttgtttatcaaaacaaggtgttttgtcatttttgaaaaatcaaaaacggtgaaacaataatctgttattatttcaacttgaaatatatcacacagagtctgctgtgacaagcttttttgcgctttttgcattaaaaacggcatctataatacttatttaagaattacttccgacgacgttcaattaaatgcacaggtgttccctcaaagtcgaatgcttcgcgaattttgttttctaagaagcgttcgtacgagaaatgcattaagtccggatcgttaacgaaaatcacgaaggttggcggctgtatgctaacttgcgtaccgtagtaaacccgtagacgtttgccgttctcactaggtgtagggttaactgcaatggcatccatcaacacgtcgtttaaggtggatgattgcactcgacgacggtgattttcatcgacccgcttgatcaatgcgggaagttgcgataaacgttgttttgtaacggcagaaacaaagataattggtgcatagctgaggtaagcaaactcttggcgaattgactgttcaaagttagataaactatggttatccttttttagcttatcccacttatttaccacgattacgattgcccggcccgcttcgtgggcataacccgcaatccgtttatcctgttcccgaataccttcctcagcatttagtactaccaaaactacgttactgttgtcgatggctttcattgcccgcatcacactataacgttcggtattttcgtaaatttttcctttttttcgcattccggcggtgtcgaccattacaaattcgtcaccattacttgtgaaacgcgtatcgattgcatcccgggtcgttcccgcaatgtcagaaacaatcacccgttgttcgcctaaaattgcgttaacgagtgaagatttcccaacgttaggccgcccaattaaactaaagcggattgcctcgtcatcttcttgctcttctttttctggaaaattagcgataactgcttccagtaagtcccctaaacctagtccgtgacttccggataatgggtacgggtcaccaaaacctaagctgtaaaagtcataaatgtcttggcgtaattccgggttatcaactttgttaaccgctaaaataaccggcttatcggctttatataaaattttagcaaccgcttcgtccgcgtcactgacgccttcccggacacttacgataaaaatgattacgtccgcttcgttaattgccaattcggcttgatctcgaatttcttctaaaaatggttcttcaccaatttgaattccgccagtatcaattaagttgaatttccggcctagccattcgctatgggtataaattcggtctcgggttactcccggagtatcttccacaatggagattcgttcccccgcaattcggttaaaaattgttgactttccgacgtttggtcggccgacaattgctacagttggatttcccatcaattggccccctttctaaatacaacattaaaaaggtcttggacagactatcattctccgccaaggcctttctaactgagttgataggcataatctagcactcgacatgttaaattattaatcctaacaattttttgaattatttatctgaatctttaaggctatcaccaatgatatcacctagtgtgaaaccagttgtttcttctggcatatccttgctgtagtcagttgctggagccttagaaactttcttttcactctttggagcttcttctaaagctttgattgataatgccaaacggcgttcttctggatgtacttcaagtactttaaccttaatgtcttgaccttcttcaagtacatctgctggagtagcgatgtgcttgtgagaaatttgagaaatgtgaactaatccttcaacaccagggaagacttcaacgaatgcaccgaaatccgttaaccgttttactttaccatctaaaacagcacctactggagctttttcagcaatattttcccaaggtcctggttgggtttgtttgattgaaagtgaaatccgttctctttctggatcaacacttaaaaccttaacttgaacttcttcaccaggcttaagaacgtcagaaggtttttcaacccgttcgtatgaaatttctgaaatatgaacaagtccgtcaattccaccaaggtcaacaaaggcaccaaagtttgtaagacgagctaccttaccagtaacgacttcgccttcttgcaatgagcttaatacttcttggcgtttttcagcacgttcagcattgataaccgccttgtgtgaaagaatcaaacggttgtcttcaggcttgatttcgataatcttaactttaagagtttgacccttataagcatttaaatcatcaacgtagcggttttcaatcattgaagcaggaataaatccacgtactccagcatcaactaccaaaccacccttaactacttgagtaactggtacttcaagttcttcgccattagcagccttttcttcaatttctttccaaactttacgagctaatagacgcttacgagaaagtaggtaactgccaccttccttatcgtcaccaatccgtgaaataactacaagttctagttcatcaccaatttttacttcgtcattaatattgtcgatatgttgcgtagaaagttcacgtaaaggtacgacaccttccacaccagcaccttgaattcccacgatcacttgacgatcgtcatcaatatcaagtacttcgccagtaactacgtcaccaacttttacttcttcaacgctattaattgcgttgagtaaatcactgttttgattaacatcattttcggccatccgaataatcccccttttacagcacttatacttatataatatcgaaaaaattgcataattgctagtaattgttgttactttctgaatacagtttcatgaacaatgtctaaaatcttctgtaccacctcttcaatcgacatggcagtagtgtctacctcgattgcatcggcagctttagtgagtggcgaaatttctcgggtagaatctttgtggtcccgaatttcaatttcttttttcaattgttctaaatctgtatccatgccttttgcaatattttccttatagcgacgttcggcccgttcttggacactagccacgagaaaaattttaacttcggcatttggtaacacagctgaaccaatgtcgcgaccgtccatgacgattccgccatctttggctaagtcgcgttgccagtccgtcaatactttacggacttgttcttgagccgcaatcgtagaaaccgcattggttacgtccgttcgccgaattgcttccgtgacttcttttccgtccaaaaagaccttttgtacgggatcaccgggttcaaaatttaacttagtttctgtcaacattgtcgcgatcttttcttcatcatttaaatcaaagtgattttgcatcgcttttaaggtaactgcacgatacattgcgcccgtatcgcagtaaatgtaacttaaatccttagcgacaattttagcaaccgtacttttccctgctgatgcgggtccgtcaattgcaatttgtaatttcttgtccataaactaactaacgacctaccttactcttaattgttgtccaggttcaatttcggagttactgttcaacccgtttaattccatcaacttctgaacagagattccgttgttaaccgcaacccgatacatcccttgaccagcttggaccgttgcgtaagacgcaccttctgcagaattagcgctgcttgaggattgcgttgttgcactgcttgaggatgctgttgacgagcttgctgacgattctactgatgacgattttgacttatcatcgttctttttcgtcgttgatgatgctgaactagcagatgacgaagcatccttttcatgcttcttagatgaagacttggctttacttgccgaatttttcttacttgatttagctacctgagtggttgtagtattcgcagttttttgctgaaaatcttgccgttgggtcatgtaataagctaacgacgcaattgccaagatgattactacccaaatcatcgaacctacaatggttttagtccgctttttttgcttatgaaactcgccgcgttccgacttacttgccgcttgctcttcagcagcctgttcattcgtagctgtttgctcggcatgggctgattccttaggatccgttgtggaagcagctgccttattttcagtgtttgctaccttttcgttagtagcttgttcctcagtaacttcatttgacgaagtctttttgattgattttttgtttttcttgtttttgctactcaatgttcgtcctcctaatgcataccaatatgatgtattttacaatattttatttagaatgactacgtaaaacaggctagttagccgcaaaaatttgtgctaatttgtccttccagctcatcatcgccaatttactagaatcatgcgactcttgcaacccgaattctgtgaaatcacttatcgaaccgcaacattgttcatcgtgtttcgtaaatggttcatcaaaatgttgcaataaaaagcgccggtgacatcccgtagtccgaattaattttaacatttctaaaatctgttgttccttttgttgcgcttgttttttaaataatttttttaattggctttcagttagaccaaattcccgataataattaaccaaagcttgctgctcttcagtttgctgttcaccatttgacagcggcaatccatcagtgtttggaagtgaataactatttaaaatagttggaatcatttcatctcccgtcgcgtacaacgtaatcgccacgcttgacttaccgtcgcgtccggcacgaccaatttcttgaacgtagctttcaatgtcgcccggcatgtggtaatgaattacgtaacgaatatcagccttgtcaattcccatgccgaaagcgctagttgcacaaatcacgtcaagctgatttttttgaaactgactttgaacttgtagtcggtcataggtggacatccccgcatggtatggcgcagccgtttgcctaagttggcgattaattagttcacttacttggctagcaatctttcgactagaaaagtatacaatgcccgcgcccggtagctggtcgatcagatttaataacaattcttccttatcagcgacgttatcggttgtcaaaaaatctagaaagatatttttgcggtctacggaagcaacgtactgctcagttgtttgaacatttaaggcgaggtatcgcaaaatttccgagcgagtgttccggctagcagtggccgttaacgctaacgtcaatggatttccaaactgctgacggacttgtccaattcgcaaatagtccggacgaaacgacttcccccactgcacaatgcagtgagcctcatccacgaccatcaacgcaatctttaagcgggcaattcgcccttgtacctctgctttttgtaagctttctggtgataaaaaaataaatttatattccgccagatggtttaatacgtatagttgatcggtgaacgctacttgagaagtaagctctgcaatttgacgctcgccactcaaacgcaaccgttggatttggtccttaataagggataacaatggggaaaccaccactaccgttccggggactagtaaaccatacatctggtaaattaaggttttaccggctcccgtcggcaaaattgctagcgtacttcgcccttccagcaatttatgtaaaatttccaactgtccgggccgaaattcctgaaatccaaaccggtccttcaatttatcataaattaattggtccgaaattgtcattgtctttgccgttccttaataaatctaatttggctaagccgaaaatcaaaaaaggtcagctcaggatactcttgcaacgcagtttgaaaatcaattcccgcaattttcatttgagcaacaccagggcttaaaaattgttggtagggaaaatcatccagcaagattgccatcatcagtaagtgttcttttacagtattaattttcacccgccgcaattctgcaattttatctacattataacccttttgtaatagctgcaaagtttgccacgtacttttgggcaaaacggagggttgcacaaccattccaattaattgattaaagggcgtcacttgattattaattaccgagctaaaaattttcctaaaaattaagcgtaaccgtaattccatttgaaatggactaacgttattaacccgggcaagctgctccaccgttaatcccaagtcgtgatggttgggtaagtagtttgcaaaccagtcggcttcttctttaggtaattgctcgcaaagtgcacccaaagcctgttggtattcctgaaccaattttggacgggacgtttcactttgtttccagttggcaaaccacttttttaccatgaagtttatctgagagtcttcacttattgggatgtaccgcgtatttttaaaactatactccgaaactacctgggttgccattagccaaagcttaattgcggggtcaaatttgactcgtaaactagcttccggtggcggcaaaactctactttgttgctgtgcctcccgttccgttagctttaacgcatcccgttccccagttaagtaacccattttaactgcttgatctaaactatttaggaattcctgacgatccagttttttccaaaaaccaatgtaatttagcaacccgtattctaagccgccataaagtgccgataccgttagcttgtttttcaacaaattcaaaatcacctttggtcggcgactttgatggcggtcaaaaaaaattaatccgtcttccggtttcatttgaatgtttaccgtttcagacgtttaacttcgctcagtttcaaggcgcgccattttccagactgcacatcatcaattgataagaaagagtagctattgcggtgtaatttttgcaccggatggccaaccgccatgaacattttcttaacttggtgattccgcccttcatgaatcgttagctgcacgatggatgtctttttttctaaatcggtactaatcagcttggccttggctttagcagttttgcggtgatcgattacgactccttcttccagacgcttcaaggctgacccattgaccagtcccttgaccttagcagtgtatgttttttcaaatttaaacttcggatgcattaagcggttagccaattcaccatcgttagtcatcaaaactgcgccagaagtgtcgtagtccaacctccccacgggataaatccgttcggtaacgtctggaaaaaagtccatgaccgttttgcggtttttatcatcgctaaccgaagtaattactccacgcggtttatttagtaagaaatagacgttttgctcgcgctgaataggcacctcatcgacttcaattcggtcatgctgttctactttggtgcccaattcttttactacccgtccattaactttaacgtgtccttcggcgattagcttttcggacttccgtcgcgaagctactccagcctcagccattactttttgtaatctttcttctgccatggttactccttgttggttgtcatttttgattcaaactcttgtaaaaataaatcctcattatcttgatcttctgcggaattttcggtatcttcaggcaacgccggcagttccgtaagatctcgtaacccaaaatagtctaaaaattctgcggtggttccatatgttttcggtcgccccggttcgttcaaccgtcccgtaaccttaaccaagtttctaaggacgagattttgtaaggtggttccgctatgaacaccgcgaatctgatcaatttcaatccgggtgattggttgccggtacgccacgatcgctaaaatttccaaagctgccgccgataatcccgcttggttggaacgagcaaaatattttttaattagcgaagctagctcgggtttggtaactaatttataggttccgcccgtttgaatcaagcttaacgccgaattggggtcttggcgatatttttcggctaacttttccaaaattgtggttaccgctggcttagcgtagccggttaattcagctaggctagccaatgcaatcccttcagctcccgctacaaaaagtagcccttcaactttttgttccttgttcattaacttcacctatcttgattgtaattgattggtctgccgaatcctgtgacaatttaatttgctggttcttggctaattctaaaattgccataaaagtggtaaccaacacttcccggttcacccggacggtaaacaaatcttcaaaacgacaaaccgagcgctgttggatccttctcttcacaaaatccatttgttcttcgatggaaactttttcggtctgtaccgtacgtgaaactggctccaacaatgcttgccgagcaagtactttttgtaaagctttttgcaaatcggtaagctcgattccaggtgctaatctagtgaccgttgcggggtcaatttccatctcaggtctcgaaaacgagcgttgccgttcgccttctaagtcccgtaaattttcagaggccgttttaaaaatctggtattcaattaattggtcaactaaatcagttcggggatcttcgtcaaccaattcttcatcctcttcgtgaggcaacagcatttttcccttaatttcagttagtttcgccgccattactaaatattctccggcaatatttaatcgcagagtttcctgagtatgcaaatactgtaaatactggcttgtaatttctgaaatacggatatcgtaaatgctcatctgcgattgacgaatcaagtgtaataataaatcgagcggcccctcaaaatcggctagcttcacgtccggtaagttatacactttagctttcatcaacttgccccatttcaaacctttcaatcattgcactcgtttttaaagaacccattaagcgccggtctggaaaaatcgacaataatgaccgaaagatttcattttcattaaaaaccgtttcttcattggcgatgaaggccatccgttctacaactacgcaatctgcctccaaaacaattagtaccaatccaatgtaagtaccatttctacgttccagataaatttgccgattctttttggtatatcgctctagaacttgctgaacaacgtcgattgaaccaaacgcatcaatcgttgacaataagcccattgcaatttgtctttttgattctgtatatttaactaacattttgctcccctgttatcaggctcgcggatggtacttatcgtatacatccactaaccgctgttgagtaatgtgcgtataaatttgggttgtcgaaatatccgcgtgtcctagtagttcttgaacaatacgcaaatctgcaccattttctaacaaatgtgtcgcaaaagaatgtcgtaacgtatgcggggtgatatttttcttgattcctgctttttgaacttgagcttttaaatttttccaaactccttgtcgggttaacgggtgaccatgctggtttaagaaaatttcattgtatcgcttagctcccagcaacgctcttcgcggaccgttaatgtaacgttctagccattggatggctacgtccccaattgggataatccgttgcttatttcctttcccaaccgtttcaataagtcccatctctaaatgaagttcatttagatttaacgcaatcagctcactaacccgtagaccggtcgcatacatcacttctaaaatcgcccgatctctaattcccaaaggtttactagtatcgggcactttaagcagccgttcaacttcttcagtggtcaaaaccgatggtaaatgctgcgcccgtttaggcgggtcaatattagccataggattcgtttggatttggtcgttaagcagcagatacttaaaaaatttccttaaacttgaaatcgtatgaatcgaagaactgcgggcccggccagtttgttttaaagcatctaggtagtttaagatggtataacgatcaacatctttaatatccgcaatatgttgctcctgcaaaaaattttgcaagtggcgcaattcttgacgataactcacaattgtattatctgaaagtccccgttcaacttttagagcgtggagataatcgttaatcagatcatccatcacctattgctccttcaaaacaatcccatcagtggtttgctcaattacgcctgccttaagcaagtgaccaatcgccattttaaaacgactcttgctaatcccaaaatgttctttgatatcactaggattgctgtggtcgttaaaaggtagttgcccatccgagcggtgttgcaacaacgctaaaatcatcgccgcatcgtcgccaagcgcttcgtaattgcgcggctttaacgacaagttcaacgtcccatccggatgaatcccaatcacccgtgcttgaaccttttcacctaaacgtggctcccgatcccgttctgaaggatggataaagcctagttggaattgatcagtaattactaatgttccggctaattttagccggtatgccgttgcagtaacattctggttaatcatttttttatttgcccggacagaaatcgccttaaaaacggtggaatcggcaggatgtgcccacattcgttccttattatccaccgtgagacaaactagtaactgatcatccacgtgtggccacagcttggtttccgttggtaattcgtcaagcgaaaccaccacgtccttgttatttaaaccgatatccacaaaaactcctaagtctttgcgaaccttaaccaccgtcccccaaccgtactttccggtagtggcttttggggcttcgcgcgtcatttgacgctcgtggttagcattttcgtaagcgaacccgctgaaattactatccttttttaaaggcttctttatttcgcttttgtcaatgcgataagtgaggccatcttcagcctgtgcaaaataaaattggtcattttcatcaataaccttcgcctgaatctttttgcctaataatgtttccatgttttctcccgtttatttaatttggatttgtaataattgaataattaagtacgctattccagaagcaataattggtccagcagcaatcccgttcatgaaaaccaccccaatgattgttcccatgactagcgcgaccgtcacctctgggctagcagataaaaagccgaccccttggtatgacaataatgaaactaaaatcccacaagcgaccgcaatccagccaactggtgacttgaatgagttaatcaagtccatgataccaatccttcccgtagcaattggaactaaaattgctactgaaataatggtcactccccagttgattccctgcttgtcaataacgctaaagagtttagcagaattaggcagcagcttaaatagtaaaacggcaattgtggcaatcattaatgattggttttttcccaaccaagaaactaataaaatccctattaaaaaaagccagctttccaatattttcactccgaacttttcagtttacataaaaaaatttcttttcaattataatacgaagccccaacgaagcttcgcattcattttttaatctaaaagtttatttattatactattgtacactattttggcttaggcgaaaaatgcaaatccccgtttttcaacgtattttcaaaaagatttagcaaattattttcttttcatattgggcgcttttttacttagaaaacactcattttccagcgcacaaaaaaagacccagggtcctagaccccaagcctttaatggttcactttaaatcttaaagtgagtttgaagcaccgtggtagataattccacgacgtgaatcaaccgtaattaattcatcgtcagaaagaattgatgtagcgttttgaacaccaacgattactggaatacccattgagattccaacaactgcagcgtgtgacgtcaaaccaccattttcaacaaccaaagcacttgatttttcaattgctggtaagtaatctttgtcagttgtctttgtaactaagattccgccttcaacagccttttggttagcttcgtcagctgatgtagcaacaactgctttaccaattacagtttcgtcgccaacaccttgaccagatgccaacttagaaccgattaattgaagcttcatcatgttagttgtaccactttcaccaactggtacaccagcagtaacaaggattaagtcgccttccttagcaaaaccaaggtcaactgccttgttagcagccaattcgaacatttcatcagtagttgcaggacgttcagcaacgattgggtgaacaccccagttaaccatcaaaccacgacgtacacgttcgtcgaaagtaattgccaagatgtctgcatctggacggtacttagaaatcatccgtgctgtgtagcctgattgagttgcagcaacgattgtcttaacgcccaagttcttagcagcgcgagcaacggcagcagccactgtttcagtaacgtcactttgatcaaaagtattgatttgaaggttaccgtcatcagccatagcattttcagctttttggtcgattttagccattgtagcaactgcttcaactgggtagtcaccattagcactttcaccagaaagcattgttgcatcagtaccatcccaaacagcgttagcaacgtcagaagcttccgcacgagttgggcgtggtttttcgatcattgagtcaagcatttgtgtagcagtaataactggcttaccgagtgcgttgcacttcttgatcaatgtcttttgtaccaacggaacgttttctgctggaatttcaacacccatgtcaccacgagcaatcatgattccatcagaaaccttcaagatttcgtcagtgttgtcgataccttcttgggattcgatcttagggaagatttgaacatcttccatgttcttttcttcaagtaattcacgaatatcaagaacgtcttgaggcttacgaacaaaacttgcagcaatgtagttaatgttcattgattcaagaccaaagcgaatgtcgctagcatctttttcagtaatacctggtaagttgattgatacgccaggagcgttagtacccttacgtgaaccaaggacaccgttgtttgtagcatgcacaactaattcgcggttttcgtcatctttttcgtcaatcttaaaatcaagtaatccatcatcaaagagaacgtgtccaccaacatgaacatcgtcgtaaagaccagggtatgtaaccgcgatcttttccttagtagtttctaagctagcatccattgagatacgagccttatcccctgtgtgatattcttggttaccatctttttggacggttgtccgaatttcagcaccctttgtgtcaagcaaaatacctactgatttaccagtaatcttttctgcttccttaaccatgttgtagcggcctaaatgttcttcatggtcaccatgtgaaaagttaaaacggaaaatatttgcaccagcttcgattaacttaacaatcgtgtcaactgatgtacttgcaggaccaagtgttgaaacaatcttggttttcttcattacagaatctctcccttgattttaaattataaaagatcttttagatcattttataccaaattaataaaataaaaaattagaacgataagtcctcacttaattggtaaagtgagtcgtctgcttgatgttttgcatcaaacaagtccgtgatgtcgtgtgcttgaaccttgttatccaagattccaaccgctaaaccacccttgccttcaagaagtagttcaacagcataagcacccatcttacttgctaggacacggtccttagcagatggaacgcccccgcgttgaacgtggccaattaccgtagcacgagcgtcgaagtcaccatattgcttaagctttttaataaactctggagcagcttcagagtttgcatcgccttcagcaattacgatgattccataatccttaccgttagcacggtttctcttaagcttgttagcaattgcttccacatcgtaatcaaaacctggtgcaatcactgcgtcagctcccgaagcaactcctgcccaaagagcaatatcagcagcgtggcgacccattacttgaaccgcaaacacccgttgatgactcttagcagtatcccggaccttatcgatcgcgtctactgcagtattcaatgcggtgtcaaaaccaatagtgaagtcggtaaacggaatgtcattatcgatcgttcctggaaggccgattgtattgtatccgtgttctgttaagcgaagagcaccgtggtatgaaccatctccaccaataacaaccaacgcatcaataccgaacttcttaagttgttcgataccctttaattggctttcttcttgagcaaattcagggtaacgggctgagtacagcatagttccgccttgcgaaaccatgtcatctaaatccgttgccttgaattcatgaatatcaccagctactaaaccagcgaaaccataattaattccataagcttcaagacctgagcttatggcctttcgtgcaacggcgcggatggctacgttcatgcccggagcatccccaccacttgtcatgataccaatacgcttcattttttcacctcaaatagaaatattgagttttttcaaaacttcattgttgattctatcacttttaaaatcagttgtctgtaccattttgccaattctttcaatgtaagtgctttaatacacgttttatttttcaaccaatgaaatttgatctgttccaagtaaattttcaaacgctttcttcacttcgggtgttccttgcaaactaaatttttcggatagtgctcgttgctgattggtatctcggtaaaccaaggtaaccggaactttaccatggtactctttgaacatcccgaataatctcttttggaaatcagcggggtttttgcggctgggtactttaattagccagtgcgtttgcccgtgtgcaagttgtcgaggcgcttcaatctgatcaacaattagctggagttggtcttcccgttgctcaactttgcccgttaactgcagtactcgtttactttctaaaagttgggtggcttggtaaacgcgggggaagattaccgctttgcactcatccgtttggtcactgattttagcaaatgccataggttcgcccttctttgttcgaattgagcgaatgctgcggatataaactatggaagttaccttttctccagctttaaactgctgaattgggacaaaacggcgttgtttaattaattccgcaaaccgttctactggatgagctgaaacataagttccaagtaattcttcttcccgatccaacttctcatcaagcggtaggtcgggacggcttttaattgtcggcattagcttttgaaataggtccacattttgaccgctaaaggtaatccccttaagcagttcgggtaaatattcgtctagttccgcccgattatagccaaagctgtccaaagcccccgcaaaaattaatttatcaattacatcttcgtcaatcccctgattgcccattcggcgtaaccagtcgtcaaccgtcttaaattgtccgccccgttcacgttccgctaataaatgctggataaagtcgcggcgtaaccccttaattgcggtaaatcccattcggatttgaccattttggtaggtataagttgcgctactttgattaatatctggagctaacgtaggaattcctaaccgctttaattcttgaatgtaagtcttagttttcgtatcattgcccaccacggaatttaataatgccgtataaaaatcaccaggatagtgtgctttaaggtacgccaactgaaaggctagtttactgtaagcaactgcgtgggatttattaaatccatagttagcaaagttttcgatataccggtacacctgttgggcaattttttcactataacccttttgaacagcaccctgaataaaattcgtccgcatttgctcaattacggcatgctttttcttgctcattgcccgtcgcaacaagtccgcttggcccaggctcaagccccccatcgcggaggccacttccattacctgttcttgataaaccaagattccataagtctcacctaaaacccgttccaaaatttggttaggaaaccgatacggttctaaataatcctttcgtttaacaaaccggtcaatattttccattggtcccggccgatagagggcgttaaccgcaacaacgagtccgaagttcgtggggtgtactttacgcaaaacgttacggattcctgtagattcgaattgaaaaactccgctagtatccccccgctgaaataactgtaaagtttgcggatcgtttaaatcaatcttttcaatctcaaattgcggttcgatacggtggaccagttctaaaatgttattcattaaagaaaggtttcgaagtcctaagaaatccatctttaataagccaacttgctcaacaaaattcttggaatactggctcatcagcatcccttcgttaccatcttgaaccggcacgctttccaccagttcgtcttgacttaaaacaattcccgctgcatgcgttgaaaagtgtcggggaagtccctctaaccggcacgctgtctcaaacataaaccgatttttcggcgaactttcaataaaatcccgtaaccggtgagaggtttgggctgcttgttttaatgtgatgtttaatttattaggaatgagtgcgctaatttggttaattttattaggcatttccccaaatacacgggcaacgtcccgaatggcctgtttagcagctaaagtaccaaacgtaataatctgccccacgtgttggtgaccatagcggtcgtgtacatattgtaaaacgacttcccgctgatcatcagggatatctaaatcaatatcaggcatctgcgctcgttcgggattcaagaaacgttcaaataaaagtccgtattgcaaaggatccacactcgtaattttcaataggtaagctactaaagaaccggccgcagatccgcgacctggaccagttaaaatttgcttttggtgtgcaaattgaaccacatcgtgaataattaaaaagtaatccgcaaagcccatttctttaatcacggctaattcatgatctaaccgtgcttgataacgttctgcgtccggaacattttccttcaactgggttaatgcttgctgacatagttgggtcaaataagtgaatgaatcctgctggttaggggttgcaaactgtggtagacgcggacttacgattggaatttcaaggttaattccagcaaccaccctatccagctgggttagcatttcggcatcacccaactgaccgtattcgcgaacaaattcagtcgcgggcttcagccagttgttaccgccgccctttgctaaaagttccggatgctgcaaaacttttcccgaatcaatgtcgcgcagcacctgggttgcgaagtgatcatcttcatttaaatattcaacgctgggaagcggtaaacaaccaatccctgctttctgcgccatctgggtcagtgtttggcgcatgacgtgagactgctgcccattaattcctaaaaataaatctggggagtcaattgattgttgatattcttcgattagtgcttgggcatcgttagccattccctgctccaataattcattaacttcggaacgtactgggggcacgatcaccactaaatctttccaataagctcgtaaatcattaaacgtaagtgttgtttttgcggaggtttccgtcattttggcagaactaatccgtagtagattgtgatacccgttaatgtttttagctagcaacaccaacgcaaactgattgtcgatgccccgggtactatctaaccaaatggtcaacccaacgatcggttttaaatcattcttcaaacaggcttgataaaattcaatcgcgccatacatcgtattattatcagtgagggccatcgcggaataaccacgatctttggcagttttaaccagctcagcgatttttgttgggctcgtcaacaaactatacgaacttaagacatgtagcggtacaaaagccatcattttccctcccgtgtttttcttaattatactaaatgtattaggcatatccaaaattcaagtttaatttattttcccttaagtttgtgctagaatagctttgttcgagaaaggggtcaattaataatgatgaaacaaatcgtagttattttttgggcatttatttttggcgaagtactcggttatatcggtggtgccctagaagtactaccatacagtagcctggagattggtacgatggctgccattaccgccctcatcacctctaacttaattccgtggctttcaaaaaaataccggtaattaagctaaagagctatcttttaaatttaaccagatagcaaccctataaaaagtaaaaacaggttggaattacttacattccagcctgttttttgttttatcaaccattacttaatttgggcttcattttgaaaaactaattggtcattgagcacgtcaatcattactgctgacttcggttttacccgtccgctaataatctccttagccaatggcgtctctacattcttgacgatgtaacgtcgcagcggccgtgcgccatatgccggatcatacgcttgttggacaatgtaatcttgggcaggttctgaaatattcaacttaatctcttggtctgccaaccggtcagataattgagtaactaattttcgaacaattttgcgaacatccgtcttgcttaacggcgtgaacatgatgatatcatcgacccggtttaaaaattccggcttaaagtatccttgcaagacgtcgcgaacttgttgccgaatatctgcgtcaatggaattttccgactggttctttaacaataattccgaacctaaattagaagtcatgattaaaatagtatttcggaagttaaccgttcgcccttggccatccgtcaaacgaccgtcatcaagcacttgcaataaaatattgaagacttccggatgagctttttcaatttcatcgaagaggacgatggaatatgggtttcggcgaaccgcttcggttaattgtccgccttcttcataccctacataacctggtgcagctcccactaaccgggagaccgattctttttccatgtattcggacatgtcaatccgaaccatgttgtcttccgaatcaaataaagcctcagctaaagctttcgacaattcagttttccctactccagttggccctaggaacataaatgaaccaatgggccggttaggatcctgtaaacctgctcgagagcgcaacacggcatcggctacggactgaactgcttcgtcttgtccaattactcgctgatgtaatttatccgctaaatgaagtagtttctccctttcgccttctactaaccgcgcaaccggaattccagtcatttgactaattacccgggcgatttctctgtcagtaaccgactcttcaacaagccattcttggtgagtgttttcagactcattttctaaatcctgcagttctttttccaaagttggaatggtaccatgctggagaaccgctgcccgatctaagtcgtaggcactttcagcttcttgtaagtcatgttttgccttatcaagttcgtttttcttatcactgatttttttaatttccgctttttgggccgcccaccgagattctaacttaactttttcttctttagtagttgccaattccttttgcagtgcctttaagcgttttgcggattcttcatccgtttcgttttttaacgcccgttcttcaacctgcagccgcatcaactggcggttaacttgatcaagttcggtagggtttgagttcatttccactttaatctttgcagaagcctcgtcaatcaggtcaattgccttatctggcaaataacggtcggtaatgtaccggctagataacttggctgccgccactaatgcattatcgtggattcgcacaccgtgatgaatttcaaaacgttcctttagccctcgtaaaatactaatcgtgtcctctaccgaaggttcctttaccaaaacccgttggaaccgccgttctaaggctttatccttttcaatgttttcgcgatattcgtctaacgtcgtagccccgattaggtggagttcaccacgtgccaacattggtttgagtaagttaccagcgtccatgctgccttcggtcttgccagcgccaacgattgtgtgaatttcatcgatgaataaaataatctggccatccgcctttgcgacctctttgaggaccgtctttaagcgttcttcaaattctccccggtacttggctccggcgattaaggaccccatgtctaaggaaatgatggtcttattggctaaattactaggaacgtctccctttgcaattcgttgtgccaatccttcgacaatggcagtttttccgactccgggttctccaattagaaccgggttatttttggttttccgtgataaaattcgaattacgtctaaaatttcttcatctcgaccaatcaccggatcgggattctcgttatgcgcacgttttactaagtccgtaccatatttctctagtgctttatatccgctttcctgttctttggacgtcactttttcacctccacgaaattcttcaatcttctccaatgcttttttagcagttactccctgctgttttaaaaaattagcaaattcattattattcaaatcaaacaacgctaagaataccgtatccaccgcaatgaattcatcctgcagcttttggcgacgctgttctgcttgaattaataattgatttaattcagtagaaattgattgaccataactaacttggctaccactaacgatgctaatttgagctaattcgcggtctagttctgcttggaccgtctggttgctaactccgagctctgaaagcaaagttcccaccgtttgatctggttgggctaaaaatttaaacaattccggaaccccaatttcttggtgctgacggttgaccgcaatttgttgcgcctcacccagcgcttcttgtaacgcagtagtcattttttcaggattcattcaattaccccctacataaattgataaggattggtattcaccgttgacggacaaacctcaacttgccattgattcgtcgccttccattggttaaataactttgttaattcgtcaatacagattttttccacgttgtgtcccacgtcaaaaacattaagatgatccgccagcatatcgtgaccagtatggtaatacacgtcgccagtaacaaacgcgtccgcaccggccgccatcatttctggataaaatttaccgccgtcaccgcctacgaccgctactttacggaccaatgcctggttatcttcagcaaccacccgcaaaccgtcaagttggaagacctcttttaaagtcttggcaaactcattcaccgtttggggttgtgccaaactgccaattcgtccaatattgcggtcgtagtgcgcagaataaacgggttgcacttccgtaagggacattgcctgtgctaaccaatcgttcataccacccgcggccacgtctaggttagtgtgggcggagtaaaccccaatggaatgtttaattaaggtagcgtacatttgattctgtggtacggtcaaatccagattacgcaccggtcgaaaaatcaacggatgatgtgaaaatataaaatcacatcctttggtaattgcctctgccacaacctcgggacggacgtctaaagtcactaatacgcggtgaatgggctggttaagatctccaatctgcaatccgactggatccttaggaaaagcactttctttaggtgccatttcttcaaaacgttcaattaattgtttcgccaacattagtcaacatctcctcaatttgcgcaatcttttttgatacttccgctaatttttcgccaccatgttgtggatgtcgctctaaattatcctgaattgattttagccgtttcaactcccgctgccactttcgcaagaaagtagcgttagcagcctgcattaaaaatgggccaaacgttaattcggtttcggtcaattgcatttgtcctggctcagcaacgatgatttcataaaggtgataatcttcagccacaatgtcttcatgagtgatttgatatccgtgggtgatgagccactcccgcagttcgtattccccaacgttaggttgtaaaaccaatcgttgcactccagataactttgcttggccttcttctagaatccgccgaatcaacaggccacccatccccgcgacacaaatcacgtcaacatgatcttctgggtttaggactgtcaatccgtcacctaaccgcgcatcaatcaaatcactaacctgatttttttcaatttccattttggaattagttaacggccccggggcaacttccccagcaatcgcagccgttgcaatttgatttctaaccaggttaatcgctaaataagcatggtccgagccaatatcggcaattttggatccttttggaactaaactcgcaactacttttagtcgtggcgataaattatttgaattcatgaaaataaactcccggtattttttgtatttattttatgctatcccaaaaagaggccctatacaaatctgcgacctgtatggaacctctttaaatgctaatctaagaaatcttttaattgttttgaacgtgaaggatggcgcagtttccgcaaagcctttgcttcaatttgccggatccgttcacgagttacgccgaagacctttcccacttcttcaagggtgcgagtccggccatcatctaacccaaaccgaagccggagaacattttcttctcggtctgtcaaggtatccaaaacgccttctagttgttctttaagcaattcataagccgcatggtcagcaggactagttgcctcttggtcttcaatgaagtcgcctaggtgtgaatcatcttcttcaccaattggggtttccaaagatactggttcttgagcaattttaagaatttcgcgaaccttatccgaaggcatgtccatttctgcaccaatttcttcgggcattggttcacgacctaaatcttgaagcaattgccgttgaatccggattaatttattgatggtttctaccatatgaactgggatccggattgtccgcgcttggtcagcaatcgcacgcgtaattgcttgccgaatccaccaggtcgcgtaggtagaaaatttgaatcccttttggtaatcaaatttttcaacggccttcattaagcccatgtttccttcttgaatgaggtcaaggaactgcattccccggccaacgtaccgcttagcaattgaaactactaaacgcaagttagcttcggcaagttcttgttttgcacgttcgtcacccttttcgattcggagggctagggcaacttcttcatcggcagttaacagtgaaacccggccaatttcttttagatacatccgaaccggatcgttaattttaactccggccggagctttagtatcgtctaattcttcctttgaaatctcttgtgcctttaaggccttttcactcgggtcaccgttttcgtcaaccacactgattccggcgtcttcgatccgttgaattaagtcatccacgtcttcgtcagtcaacttgaatttatcgatcaaatcacgggtaagcttagtgtacttaaccttgtgttcacttttttgtgctttaataatttggttaactgcctttttaaattctggtgaagaaatgatactttcactctttttacgtttgatttcactttttttacttgccatagttagctgttccccctctaattttggagcttttgttgtttttgataaagagaaataagttttagcgttaattgctgttgtaattcttggttacctaatctggtagcttcgtttaaatccgacttaacttttgaaatctgttcgctgagcggggccacgtccttaatcaaactaatgtagtcttcgatttcttcttccgtgtaatcgggactcaaattaatcgactcaatattagccactaccgactgtaactctggttccttcaaataatccatgaagtctgccgcatcatattcttgattcttggctaggtatcctccagccaacatataaatagtttccagttgctcatttggaaaataaaaatccggcaagctttgtaatttcaaccatacgtcgtgatgattaagtgcgcgggctaacaaccggtactgcgaaatatccacacttgatagcttcttagaagtattttcggttttctcaacttgattttcaaaagtaggtggcggcgcgggggccggtcccggatcaaactgccgaggagtatgcgcaatccgatcagccacgctttcccgtaactggttcttcaaatcacgcttatcaatactaaattcttcagcaagttggttaagatataggtcttgttccaaagcgtcatttaattcaccaatccgtcggagagctttttttagatattccagctgatcgttttcgttagctaagtttaaacccatccggtcaaatttcaataaaaatgccgtactggattccccagtctgattcattagtttttgaaaagactcaacgcccttatcccgcacgtattcgtcaggatcacggttatccgggataaaaatgacgctgatttgcaaatcactagtctgtttaattaacgcaatggccttcgcaattgcacgttggccgggctcgtcgccatcaaagcagattactacacgggaggcaactcgtttaagtgctcgcacgtggtcttctgtcaaactagttcccatcgtggcaattccattagccacttgggcccggtgagctgcaattacatccataaacccttcatataaaataacggttttcttttggacaatttcagggcgggcttgcgaaaagttatagagtacctttcctttgttaaaaatgctagtttccggactgtttaaatatttcggatgttggtcatccttcaccaagctccgtccggaaaaagcgacaatcttcccattattatctttaattgggaacatgattcgattaaaaaaccggtcctttaacgaaccgtctgctgtttcaataaatagtcctgaatcttgcatttgtttttgatcgatttgctgttccttaagaaaacttaacagcaaatcttggtctgccggtgcaaaccctaaatcaaaatcctgcaggtctgcttcagtaattccccgcttttttaaatacgcgagggtcttttcacctagttgcgtattcaccaacacgtggtgataaagttcagcagccttttcatataagccaatcatctcactttgagccgctgaataagctgacttaggagacttctttacgtacttatcgtctagggggacgttgccaaactccgccacgcgccggacggcttctgggaaactaattttttccagatccatcaaaaacttaaatacatttcctccacgtccacaactgaaacagtgaaaaatctgcttatcttcggatactgaaaaagaaggtgttttttcatcatgaaatgggcaaatgccaaacaaattttttccagcttttctcaactgaacgtatcgactaactacatcaacaatgttcacggcggaccggacgttgtcgataacttcttctggaatcataccagccattctatcacccacttccgtaagatagactcatacgatagtatattacagcactccctactaataagcaatcaaaacgcacctataattaacacttttgtcaagtatgtaaaataagtgcttaaatattgggattacctcatttatagactaagctacctcaacctcccccaaaaatttcacaaaaaattctaaaaactagtgaagacaccggcagccctgctaaccttttcactccaccaaaaaatctgttggcagtaatcacttttcaatcactgtcaacagattttaaataactattgccacagcctcgctagcgagctcgcagcttttttaaaatttcaatttttatttaaccattaccttagtcaaatctccaacacgaagaaccaagtttgctaaacggctcatcatgtttaaccggtttgctttaatctttgcatctttatccattaccatggtagcgtcaaaatattcggtaattgctggggtcaaactagtcaattccttaaagaagactgccatgtccgcatcattcatcgcttcaatcttagtgatcaagtcaaagagcttaccttcagtttcgttattgaataattgcgaatcaactgccaagtcaccggcagtggtgtttttagtagcaatccgttgtacccgggttaaggcctcgatctcatctttgaaggaatccgcagccttcgagttagttagcacttcggcagccgcaatgattgtcgttacgttgtgctggcttccggcaagcacggcatcttcaatatcatagctaaccgactggtgatcaaggtattgcttaattcggtcattgaagaattccaccacttcggcaaagtttttatctacgtctaccccaaagctagtttggtcgtccgccaacgcttgcttaacagcttcttcaaatttgttcaagtctagtgaccaatcccgttgagcaagaattcgaacaatcccgtatgcgtgacgccgtaaagcatacgggtcatttgaaccgcttgggatcattcctgcactaaagaagctaaagatattgtcaaacttatcggctaaagctaatactgctcccacagtgctttcaggaagttcaccttccgcactatttggcatgtagtgttcccgaatggcttgcgctacggctggtttttcgcccttcaatagagcatacttttcacccattaccccttgtaattcagggaactcacctaccatcccggtaaccaagtcaaacttgtaaattgctgcagcacgttgcaagtcttcagctgtttctgcatctaaaccgagcattttagcaattacttgagcgatggagccgacccgcgtcatcttttctgccatagtaccgattttatcgtggaaactaacctttttaagtcggtcaacgtagtagtcaatcgaattcttttgatcttcgtcgtagaagaaggcggcatcttcaagtcgagctgttaacactttttcatttccacgaataacgttttctaggtgttccttgtttccattccgtacggaaataaagtttggcaacagcttgtcgtcctgattccgcacgaagaagaaccgttgatgatcacgcatggaagtaattaaaacttcttcgggaattgccaagtacttaggatcaaattttccgctaaatgccgttggccattctaccagattatttacttcttctaataagtcagcgttcggcgtcacttcccagttttcttcttgggcgattgcttgaatttgttcacgaatcaacgctttgcgtttttctgcgtcaacaatcacaaattcagcttgtagcttttcttcgtactcacttggattagctaagtcgaccgttttacctaagaaacggtgtccttggctttgccgtccggccttgatgtccaaaatttggaaaggcaaaacctcgtcgtccaagatggacaccaaccagcgaatcggtcttacaaatttaaagtcgtagttcgcccacttcatcatagtcgggaagttcaatgattccaccacgtctttaatgcctggcaaaatttcttgggtagttttaccttgaattaacttgtgtacgtatacgtattccgtgcctttaatggttttaaaggtaatgtcgtcaactgttaagccttgtcctttagtaaaaccaatcgccgcttttgtccaattgccatccgcatcttgggcaattttccgggcaggccccttagcatcttcttcaatatctggctgacgatcgccaagtccattgattcgaattgctagacgacgaggtgtcgaaaattgctcaatagaatcatagctgagccggttttccttcaaaaatttagtaactttttgtgctaattgttggatgctcggtgtcaccacgtgtgcgggaatttcttctaaaccaatttctaataaataactatgagccattattttacctccttgtcgtcattttttaataatgggaaaccaagtttttcacgttcttcaacaaatgcgcgggctactttacgcgccatgttgcggattcgagataggaatcctgctcgttcagtaactgagaccgtcccgcgagcatcaagtaagttgaaggtgtggctacatttcaagatgtagtcgtaagccgggtgcactaagcctttttcgattaaccggttagcttcggcttcaaaatcgttaaacatggtttccaacattgcttggttagattcttcaaatgaatacttggaatgttcgtattcaggttctttaaaaatgtctccgtaggaaacgccattcccccactctaaatcaaaaacggattctacgtcttggatataggaggatagccgttctagtccgtaagttacttcgctggtaacggggtgtacttcgagcccccccacttgttggaagtacgtaaattgggtaacttccattccatcaagccaaacttcccaaccaacaccggcacaacccattgaaggattttcccagttgtcttctacaaaccgaatatcgtgttcgaggggatcaatccctaaagcctttaaactacccaaataaagttcttggatattttccggtgacggcttcatcactacttggaattgatgatgttggtaaagccggttagggttttccccgtaacgaccatctgctggacgccgagatggttctacgtaggcagcattccatggttcggggccaattgcccgtaagaaagtgtagggactcatcgttcccgcacccttttcagtatcgtaggcttccatcaacatgcatccttggtctgcccaatatttttgtaaagttaaaataatttcttggaccgaaagctttttattcataagttcctcctttaaattttacggacaaaaaaagcccctacgtagcataaaacacactacgtagggacgataattatcgcggttccaccctacttccggtgagttaatttctcaccgacagcttgaaatatttatctcttaaggactccaaatgccccacggaaccgttcctaaccagcttccactatcctggtttcgctaatagtacggaaaatccgctttgttcttcactgtccgatttaacagagataataataaaaaacttttaattggttgtcaatataattaatgcgcccaattttgcatttgatcaataaaatgacgacttttaaggttaatcccaacttgatcttgataaattcgctcagttaactgccaaatttctcgcttagttgctggtgaaaccgaaatctggcctaatttaaaaatactgaccaaactaagcattgccatggttttagctgctttaacgctaaggtgccagcggtgttcgtctaaatgccagtgattttgacaaagcatcccgcctcgcgactcagaataatctaatgccaaatcgcgacgtccgcaaacgacacaatgatcccaaacgattgcaatcccaaaggaatttagcaattgaatctgaattagatccgtaattacttccgcatcgttaccagcgtcaatcagggtcagcgcccgggctagccggtcaaaccaagcttcaattttaaaattatcatcaaatgcagcgtcaactaaatttaataaaaaagtggcgtaggcatttaattcaatatcctgaaaaatattttcaaactgtttaacgtctagggcagcgttaatatacgacagcccgttgctccggattaaccccgaataacgaccgtgggtaaacggcaaaattgccgaacgcaacttaaaatccttctttttggcattcttgatgaaaaacatccgtttaccatattccctagtaaggaatttaaccaacaaatcgttttcccggtgatttttggcaaacatcaccatgccagtaaagtccgcgttcaccaattggctcatatttaatattcgtcctttttataaccgaaggattgcaaaattccttgtttatcacgccatccttcagaaactttaacccatagttcaagataaacccggctacctagtaaatgttcaatgtccactcgcgcccggctgccaatttcttttagcatccgaccgcctttgccaatgatgattcccttttgggtggggcggtccacaatgatcgttgcgctaatatccacgaggtcatccttaccaggtttcatggattcaataactacggctacggaatggggaacttcttgccgagttaactgcaatactttttcccgaatcaattcagaaaccacaaaccgttctggatgatcggtaacttggtcgcttgggtaatattgcggaccttcgggcatctgtttactcaaggttgctaagagctcgttaatgttgttaccttgtaacgctgaaattgggaaaacctcggtccaatctaaagcatcccggtacgaatcaacaatcggtaacagctcgtctggatgaactaagtcaatcttattaattaccaaataaattggccgattcttaattttcttcaaccgttcgataatgtagttatccccggcaccccgtttttgatccgcattgaccataaacattaccgcatcaacttcgtttaacgaagatatggcggattgaaccataaagtcccctagtttattgtgagctttatgaatacctggagtgtcgataaagacaatttgttcgcgatccgtagtgtaaataccttggatcttattccgggtggtttgtgggacgtcgctcataatcgctaccttttgaccaacaacgtaatttaaaaaggtcgatttaccaacgttaggccggccaacgattgccacaaagcccgaatgaaaagcttgtttattttcttccataatcacgattccgtttccttaattttaaaaaaagtggtgtgcaaaaaccaataatccaatcaagacggtgaatactgcggttagtaagaccgctgctgacgcggcatccttagcctgtttaactagaaattggtacttgccattacaagcaaagtccgccaatcgttcaattgctgaattaaaagcttccgccacaaacattgctccgatacaaaccacgatcgcaatccattccatcagtgacaagtgaattgctaaaccacagccaactactaacaccgcaattaaacagtggtaacggaagttgcgttcccgtagaaaaatatctttaaccccgtacatcgcgtgggcaatcgattggattagtgagcggttcttttcggtttggcgtttatctttcaagaccataagcactcataatttctttttgaagcgggaacattttttcttggtcttcctttttcatgtggtcatagccgttaagatgtaagaaaccatggacacataaaaatcctagttcccgttcgtaagaatgtcccaaaaattccgcctgttcagcaactttgtcaaccgaaatcatcaaatccccaatgttatccggaatttcttctgccatttcaggatccataataatatcttcatcttcgtcgttaattgcaaaactaattacgtcagtaggacgatctacgtggcgatattcgcggttaattttttgaatttcatcattatgcattaaggtaaccgaaatttcggttgccacgtctaattttaaataatttccggcaaagtctaaaatgttcgcaattaaatccaaatgttgttggggtacttcttcagtatgatcaaatatttgaatatccatcatattatcctttcgcttctttttcgtcgtaagctttgacaatcttcgcaactacaggatggcgaataacgtcgttagcggtgaagttaacgaacgctaccttattgacgttacttaacacaatttgtgcttccttcaagccactgcgggtgcctcgcggtaagtcaatttgggtcacatccccattaacaatcattttagaaccaaatcccaaacgagttaagaacattttcatctgttgattagtcgtattttgggcctcatcaaggattacgaacgcgttatcgagggtacgtccgcgcatataagccaacggcgcaatttcaattacaccacgatctaataaacgcgtagtgtgttctgccccaataatttgatacaacgcgtcataaactggtcggaggtatggatcaaccttttctttcaggtcacctggtaaaaatcctagactttcaccggcttctacagctggccgggtcaaaatgattcgttctacgtcgccccgctttaaagctgctacggccatcaccaccgctaagtatgtcttaccagttccggccggaccgattccaaacgtcacgtcgttattcttgactgattccacgtactgccgctgtccaaaattcttaatccgaattggtttacccttcgcatccttaattaagaccgttgaataaagctcgggcaggtagtttaaggtccccttttcagccatcttcatggcactaacgaaatcggtgctgctaagttgcaccccggtttttaaaacttgaaccagcgttttcaaaattgcaatggtttgttctacgtcagtttgtgcgccctttacggtaattcgttcgccaaacggaagtaccttgacgttcatcccttcctcaataatcggcacgaagcgttcctgattaccaagcagtgacatttctaaatttggatctgataatatgagattcttttcgaacaactcttcagacacgttaccttcccctaacctaaggtattttttacaatttcgttaactttggcaccgtctgccttaccctttactttaggcatcaatgtcgacattacttttccaaagtctgccttcgaagttgccccggtctcttcaattacttggttaatgatttcttgcaattcgtcatcgcttagttgtttaggcatgtacttttcaacaacctttaattcagcttcagtttcttttaccaagtcatcgcggttaccctttttgaactcggcaattgaatctttccgttgcttataagcgcggttaattaccgtggcaaaatcatcttcggttaattcgtgaccaatccgaccttgttcgtttaagagttcggacttgatcatccgaattacgcttaagcttaatttatcatgggccttcatggcagtttttaagtcgtcgttaatttgctttgtaaaatccatttttattctccttttagtatacaaaaaaagctcctgaaattcaggagcgatgatcggattagaagcgtttcttgttcttgcgctttcttgcagcttccgatttcaacttgcgttttacgctaggtttttcgtaaaattcacgtttacgatattcttgtagagtaccagactttgacaccgtacgtttaaagcgacgaagagcgtcatcaagtgactcgtttttgcgaacaactgtttttgacaatgtgattccctccctccgagctttgaaataacaattcgtacttagtactcatgtttcttaaacattataactgaactaaaccataccgtcaacaacaaataattaactagttgcataacgatttgtttatcgaaaccgttttcttgccttttaaagttatgttactatcatataaaaggataacaggagcgaattaattatgacagaaaacaaacaaattactaacgtttttatcatttccgattccgtcggagatactggtgatcaagtagcccgcgccgccgctgcccaatttttagaggaccacttgcgtttttctcgctaccccttcacccagaccatttctttactagatagcattttaaaaaaagctgaacgggaaaaggcaatgattttttctacatttgttgatccaaagcttaaccaacgcactaaagctttttgccaagaaaaaaatttaaaatattttgacgttctgacccccgccatccagctttttgccgaggagaccggcctaacttcttccaatactccaggaagacgccactcccttaatgaaaactatttcgataagatctcagcaatggaatttgcggtaacctacgatgatggtaaagatcccgctggtttcttaaaagctgacatcgttctactaggggtttcacggacttctaagacgccgttatcactttaccttgctaataaggggtataaagtagctaatctgccattggtacctaaaacccaaattcctgaagaaatttggcaggttgatcgcgataaaatttttggtttaaccaccaccaaggaaattctcaacggaatccgccggcaacgcatgatttcatacggtttgaaccccgattcctcgtacgcagatatggacagcattaataaagaactccaatttgcggacgacctatttaaaaaaatcggctgcttagtaattaatacggctaataaatcaatcgaagaaaccgcgacaattattatggaaagcctcgcgtaacctcatttaagaagggtttaatatgaaaaaaacattagtgttcttaggatttgcggtagtgttaattggaagcattactttaggatggcacctcacgcatcgtcctagctctgccgctaagcaagactacgcccaagtttataacgcacaccaaagtaaaatcgccaccatcactaatcatcaaaaaattagttacttatctaacctccttggcgatttggggtcagcacggagagttcacccaaaaaagcctcagaacagccagttgctccgtcattttaaaatcgttcaaattaatccgtcggccaaaattgacgcttttatctaccggaaccacaccattacggttaaaaatcttcccgtggttcattctggaacctggcacttaagtagtcagcagtatcaaaaattaacgcatttacgttaattttcacgatcagcaaaaagaggcaaaaaaatcattttggtgcatcgtttttaatgaagccaaagcgtgcgccaaaactcaatttattctgcttaactaaaaatcgctcattatgcctaagtttggcataatgagcgatttttagttaacgttcaccaactattcgacttttctctgacgcgtgttttacaatgcaccgttctagtctgcgcttaacgcctaaacaaacactattcttgcaggaccttcgttaataaatccggatcaaagtcccctgatttaagcatttgaatttcaaggcggtaaggagcatgcttcttgccatccggatccttaacctgcggagtttccaaaatcttgggtatcttcgccaagcgttcatcatgagcaatgcgatataaagcttcaaaaccaattgttccaaatccaaggttggcgtgccggtccttatggctccctaattcatttttcgagtcgtttaggtgaattactccgatccggtctaaaccgatcacctgatcgaattcagccatcacatcgtcgaaatgattcttcacgtcgtagcccgcatcgttagtgtgacaagtgtcaaaacaaactgaaagtttatcgttatgggttaccccttcaatgatttgacgaatttgttcaaagttcgtggctacttcagtaccttttccagccatcgtttcaagtgcaatttgaacttgctgttccggcgtgatgatctgattaagcccttcaataattgaagaaattgccgcgtctgctcccgcacctacgtgggcgcctggatggagtaccaattgactagctcccaacgcgtctgctcgttgcacttcttctcgtaaaaagttaaccgcaaatttaaaattcgcgggttttaacgtatttcccaggttaacgatatatggcgcatgaataaccgttgcctgaaagttatgttgtttaaaaagtgcctggccttcctcaatttttaattctgtaattggcttacgccgggtattctgaggagccccggtataaatcatcaaggcgttggcgccgttagcaatgctggtttccacggaacccagaaacatttttttaccactcatgctgacgtgtgatccaataatcaaaattaatccctcccgtagtgaatttttttaataatttgttgagcagcgtccccctgctcccattgcacaaagcgtttagcaaattggttaaaccgcgactgatctaaaatagcaaaatcattctgcgctaactgatgaacttcccggagcagatctgccgcagtagtggcaatggggcccggtagttcgtgatagtagtcaaagtaaaagccacgcagatcatcccggtagtaatcaaggtcgtaggcaaaaaacaacattggtcgacgtaaattggcgaaatcaaacataactgaagaatagtcggtaattaataagtcggtaaccaaataaatttcgttcatgtcgctagtagaatccaccaccacccggtcttcgtagcccgaaatatcaatccgatccgtgactaagtagtgcggacgaatcaatagcacaacgtcgtcaggcaaaacgcgcagcatctcacctaaatcaaaatgccaacgaaaatgataatgccccaccttaataaaatcatcttcccgccaagttggcgcataggtaaccacccggcagtccgacttaccaataattttttgctttaatttggcaattgcagcaacgttattcttttgaaaaagaacgtcgttacgcggataaccagtttttaaaaactggtgatgaaaactaaatgcgcgttcaaaaatatctgctgaatattggttggccgcgactaaatagttccaacgatccgcctctttaacaaattctgctaagtaacgttcccgactatttccgggaaacttaacctgatccatatctaaagcaaggtgctttaacggggttccatgccaagtctgcacgtaggtggtccgacggttctttttccaccaagttggcatccgcgaattaaaaatccaatattcagcggttgccgaagtccaaatccaagttaacgaccagcgtttaacgattttagcttccggaaatcgagtagtcattgtttggtaaaattcacccttaacgccccaaactaactggaaacggttttccggaaactccttaagtaattcatcataaatggccttaggattatccgtcagccccttaccattaaaactttcaaataaaacgcggcccttatgaaccggcaactggatcaacgcatcattaaccagtattaaaccgtatcgaattataattttaagtacttgtttgagcttacgcattcgtcaaaatcccttcaatctgctgaattagtcgggctcccgcatggccatcatttagctcgttccactgttgatttattttttgcaaactattcttgctagaatggcggctttgcaaagcaacgttgagctcggctacgttttcaactagctcgtcgaaaaacatctgtttgaagctggcttgaatgccaaccgtttgttcaaattgtgcaagatcgtatgtaaagaaaatcaccgcattggcgttatctaacaagctaaagtcaaatgcgatcgaagaatagtcggtaatcagcgtatccgctacacacaataactcttgggtggtaacgtgatggtcaaccgtcaccacccgatctggagaattcgccaccagctgctgttccagttcgcttaagtgcggatgcagtcgcaccactaaaacggcatcttcgggaactaacaaatgggaccaatccttgggcagctcaaacgtaacgtctttgcggtacgttggcgcatataaaagcacccgttgttttttaaactgcggataatcctgaaaaactttggcccgagccttttgtacccaggcttcattaaaatattggtcggaacgcgggtatccaatttgagcgagtttagctgagctaactttccagctttgttcaaagacttctgccattttagctgaccccaccacaatttcgtcaaagctattataaacctgttgaaatcgttgctggtcggctactgaccgatgataggtgctggggtcttcccagccaaaagccttaattgccccattagcgtgccagatttggataaaaaattgttccttcaatttagcaatcgcacttaattcaggatagtaattatcaaatagggcaacccgggcagcccggattcccctaacaaaactggttatttgaaatttgcggaactcaagcgtgtggcgcaccactcccgcgctttttaaacgttggacctccgcttttacagccggttcataaaccagcagcaccgcgtcagtaccaaaatggctggttaattgtttaataaacttggcgttccccgtaaaactcataaaatacgcaattttaaagtgcgtgggacgtcggcgcaaaaaccaatcaactagccgaactagcagcaaatataacttcttcaagaaaataaccccttataaggtcggctcgtaaaagtgacctagaattttaattgtgtccgtaatacttacaaaagcgtgcggatcggaaacttccatcgctgcttctaattccggcatctcataccgcgaaacaatcgtgaaaagaaccgttttttctttgtggttatacgcaccttctgcaccatggataatggtaatcccccggcgcatattattttggatactatcaatcacgctcttaggccgatccgtaataatcatcacttgcattttttgttgccgcgtataggtcatgtccatcacttttgcgttaacgatcaacccaattgctgagtaaaatgcgtagggccaaccgtataggaaaccagcggccgtaacaatcaaaatgttaaaggcgatgttgatgcttccaatgctgtgccccgttttacgaagaatcgtgatccctaaaatatctaatccaccagttgaaatcccgcttttaagggctaatccggttccataaccgttaactgccccaccaaagagagcacagataatcgggtcggtagttaacgtgaccgggtgaatccacttaatcatgatactggctaatccaaccgagataatggtaaaaatagtaaaccgcggactaattgccttccaagctaatacaaataacgggacgtttaacgcaaaaagtaagatggcgaccgaaacgtccatcgaaaaaaatcgttttaagaccgtagcagccacctgtgccgctcccgtaactccagaagcatagatgtgtcccggtgtccaaaataaattcatcgcaatcgaaactaacactgcgtaaataaacgccgtagaaattcgtgcaacgtactgatgtcgtttaacaatcttatttatctgatgacccatttccctatatcaatcactttcatattttatttaaattcaacatttaatataacattttaccgcggttaaaatgaaggttttcaagcggttattggagatttttaagataacttcccttttatcattaaataccgattaattaatgattttattagtccggtttaaaaataaaaaaggcggaaaaacctttgcaattatgaaaacatcctagcgactaagtaaattgtctaacctagttaaatattttcattccaacaaaagtcttcccgacctttttaaagttatttttcaggtttacgaatatcaacatccaaagatagttccgccaactgttcttccgataccggagttggtgcttcggtcattggctctgaagccttggagttctttggaaaggcgatcacgtcacgaatgttatcccgtttagctagcaagcgagcaaaccggtctaatccaatcgcgagtccgccgtgtggtgggaaaccgtagtctagcgccgttagcaaatagccaaactggtcgttagctttttctagcgtaaatccaagggccttcaacattttttcttgaacttcccgggtgttaatccggatggagccgccccctagttccaaaccatttaagatgatgtcgtagctttgcgcatgtgctttatgcggatcttcgccttcatctaggtaatgtaaatcttcttcattaggcatggtgaacgggtggtgcgccgcaacccaacgttcgtcaccttcatcatattcaaacagtggccaatctacaacccacaggaaggcgaattggtcttcatcgatgaggtcgaagcgtttagcaagttctacccgcaaataacccaaagtatccgcgacaactttcttgcggtccgccgcaaacaacaataagtcgcccactttagcgtctgtcttagccatgatttgtttttcggtagcttcatcaaagaacttcgctactggtccgctaaagccttggtcagtaatcttcaaccaagccaagcctttggcaccgaagcgttctacatacttagcaagcttgtcgatttcctttcgggaaagtttagcagccccatcaggaacggcgattgcctttaccactccgccgtttgcaacggctccgctaaacactttaaattcagaatcagcaacaatttcactgatgtcctttaattccattccaaaccgtacgtcgggttggtcagtaccgaagcgatccatcgattcttgccatgaaattcggtcaaatggcaatttaacgtcaatatccaaggtgtccttcattacccgggcaattaatccttcggtaatgtcttgaatttcttccgcggtcaagaaactagtttctaagtcaatttgggtaaattcaggttgccgatctccacgtaaatcttcatcacggaaacaacgtgccaattggtagtaacggtcaattcccgctcccatcaacaattgtttgaaaagttgtggtgattgtggcaaagcataaaagtgtccagggtaaacccgtgaaggcactagatagtcacgggccccttctggagtcgacttagttaggtcaggcgtttcaatatctaagaaaccttgttcatctaggtaactgtgtaccgcttgagtgatccgattccgaattttgagacccttcaacatttccggacgacgtaaatctaggtaacggtacttcatcttcaattcgtcagatgcgttcaccccgtcttcaatgtcaaacggtggagttttagctttgttcaagattttggcttcatgaacttcaacttcaatttcccccgtcttcatcttcgggttgacgtccttaggcttgcgttgtttaaccaccccagtaacttcaattacgtactcactacgcaattggtcagcaacggccaatgcgtccgctgaaaattcgttactaaaaactaattgaacaattccttcccgatctcgcaaatcaataaagattaattgtcctaagttacgtctcttttgtacccatccctttagggtaacggtttgatcaaggtattgttgatcaactagtcccgcatacgttgttctcttcatctttttctcctcacgttactttaaatcattttttatatcttttagttcatccagtgataaggtcttttccgtccccgtagccatttcttttagcttgaagacgtgcgcttgcatttcagcttcgcccaccgtaattacgtaacgggcattaagtttatcggctgatttaaattgcgcctttggttttcgttccaagtaatcttgttcggtaacaaagttcattttacgtaattcatgaacgatcttaagggtctcagtttgtacagcttctccaatgccaaccacgtagaaatctagccggctagcttgtaaggctgcttgagtttgttcgtttaatagtaacaagagccgctctacacctaagccaaagccaactccagaaacttcggggccgcccaattcctgtactaatccgttgtaacgaccacccgcgcagatggtaacgtcgccctttccaagagcagaatcagcaaccataatttcaaagatggtgtgattatagtaatccaagccacgcaccattgacgaatccactacgtaaggaattttcaaagcatcaagttgttccttcacttgggcaaagtgcttttgagcatcttcggttaggtaatctaaaatacttggcgcatccttaacgatttcctgatcggtggcatccttactatctaaaacccgtagcggattcttatgtagccgttcttttgaatcatcgctaagttcatcgtagtgcggttccaaataatcaattaaggcttgccggtattgctgccgacttgcttggtcaccaagggtgttaattaccaatttcagccccgcaacctttaattggctaaggaagtccattgccatggtaatggtgtctacgtcaattttaggactgtcacttccaaaagcttcgaccccgatttggtggaattcacgtaaccgtccggattggggacgttcataacggaacattggccccatgtagtaaaccttcactggtttttggtgttcaggaccatacaatttgttttccacgaaagcccgcactaccccagcggtaccttcggggcgtaaagcaatgtgccggccacccttgtcatcaaaatcatacatttctttagtgacaatgtccgaagtatctcccgcactccgcgaaaagacttcgaatttttcaaacatcggtgtccgtatttcttcataattataaagcgcaaaagtttcccgcgctttttgttctacaaattgccattctttagagtatggcggcaaaatatccgccgttcccttaggcttttgatacttcatataaatcacctcaactagtttttaagtcagtaaataaggaatttgggcgaatttaaaatactattatgaaaaatgcttagagtcttaagggaccaacagaaaataaaaaacgcccttgtataaacaagggcgtcaaaacgcggtaccaccttagattgtactctatagcatcataacggctgctaacccatctccaaggtgtcttcaatacgatccatgtactcttttccatcccccgagctctctacaacatgtaatcaatatttaatagtccttttcaccgatttatattaactttattattaaaagtactaaaaaaatgctagttagtcaagctagattctttcataaacctccgtcatatctttgatataatggacagagtgaatcaataaaatgttaagtgagcggaatatgaacaaagagattatttttaactttattaaaagaaataccttgcaaatcattatatcagccggcttcctcattgccgcaattttagtaattgtccccctattcagcgccgagagcgtgtacgtaggactcgatcaagtggccattcggaactcgcctaatcgcacggctaaaaaagtcggttccttagatcaataccaaaaggtgaccgtagtttccaaaagcaacgactggtaccgggttcgttttgacgatacgaaaactggttggatcccttcctggattactaaccgaacctttaaaaaagggcaaaaagaaactccattagccgaatccaaaattgtcctggaccctggacatggcggagttgactcgggagcgttagccattaatcaaaagcatcaagaaaaaaaatatacgttgcggacctcgcaaaccatccaacaaaccttaaaaaatgctggagcaaaggttattatgactcgcgatgacgatgccttcgtggaactagctaaacgtccccaaattgccaaccaagttaaggcggatgcatttattagcattcattacgattcggctgacgtaaacaattcgggaactggtgacacaacctattattatcatgataatggttcaattcaattagccgaagcggttaaccaccagttgattaaatcagttcctttatacaatcgcggagttaaatttgctaattaccaagtattgcgggataaccgccgtccagccattttgattgaaggtggctacatcaacactagggacgactttaaactaatttcaagtgccagctaccctcaaaaggttgctactgccgtccgcaaagggctagaaaactacttagctaagtagtccctaatggcagcaaaattagtggttgtaaattctggggcactagtcacatcaatcagttggtctggatcaaataaaattcctttaatagcagcgtgatgtgcggcatcgatatctaaatttcgatcgccaatcatgtacgctgctttttgattaacgtgatgtttggtgatcaaataatttaaagaggccggattgggcttccgcggaaaatcttgatctcccgtcacaaagtcggtaaagtaatcccgcaacccgtatttttgtagtaaatcaattgcggcttggttacggtgggtcaataagaaattgtgtccaccttgggcagtaatctgagccaacaattctttgacgtcggaaaatggctgggcttcaattaatcgtggtgtttcgatttcacgaaacacccgtttaaattggttagcgtcgagaccgttagctttggccgtcgttttaatcgcaaatcctaaagaatgttgtcgcatttgttcgtagactagttgaggatttaccgttactcctgcttgctgagcagcatccacaaacgcggccaccattaccggataggtattaaataaggtcccgtcaaaatcataaaaaatatccattttattactcctttattacacttaaaaagaggttgcaaaaatcgggtttacttgtcagtgcgccccattttcacagcctcttttgctttattattctttattttgcgtatctaaaagaatggtcaccggaccatcattaaccaactcaacctgcatatccgcaccaaattctccagtttgtaccggaattccagtttgggcgaggcgttggttaaattcatcataaagccgactagcggtttcaggatttccagacttggtaaaactaggacggttacccttcttcgtcgatgcaaacaaggtgaactgggaaactgacagaatggctcccccaacttcgttgatcgaccagtccatctttccttcctcattttcaaaaatccgcaagttagtaattttacgcacgacataatcaaggtcagcggcggtgtcctgatcgttaaaagccaccaacagcattaatcctcgattaatttttcctaccgagcgctcggcaatcgttacctgagcccggctcactctttgaactactactctcatttttcactcctaatgggtcgggcgtttaactacgtaaacgtccttaacgtttttcaaactttccattacccgttctagatgggccaaattatgcactcccatcgataggctaattaccacgattcggttatggttaatctttccgttaattgacgatagattacgcgtcgcgttgttgaccgatttcaataagtcatttaataaaccgttccggttgtatccttgtacttccaaatcagcggaatagtttcccgaagtatcgtcgggatcttcccaactaacttcgataattcgttcaccctgttcttcggcactcttaacgttcgggcaatcttttcggtgaaccgaaacgccccgccctttagtaatgtacccaacaattgggtcaccaggaactggcgtacaacaatgactcaagcgcaccagtagattatccgcgccctcaataactaccccttccgaagatgccttggttttactcttcggacgatggtcgtcagtggaaattgcctgatgattttcaagcatttgccgttgaatttctttttggtggtcagcttcagcctgttcacgaatgtctttagttagtcggttagcaatccccacgggggccaaatcaccgaacccaacggcagccaacaagtcatccacttggttgaaattcaattgtttagcaacctgagcgagattttcatcttccagaagttcgctaggatcgtaaccagtttgttctaactgcttagttaaaatttcacgacctttttcaacattttcttcatgattagcctggcggaagaattgtttgattttgttacgactccgccgggttgaaaccattgtcaaccagtcccgacttggacctgctgaattttttgaagttaaaatttcaacgatgtcaccgtttttaatcgtgtagtctagcggaacaattttgccattaactttcgcaccggtggcatgattaccgacttcggtatggatggtgtaggctaaatcaagcggacccgctcctttaggcagttcaaaaacgtcgcctttgggagtaaatacgtaaacgcggtcaccaaataagtcacccttaacaccttccatgaagtccgctgcgtcattgctttcgtcctgtaattcaacaatttccttaaaccaatttaacttagcatcggtagcattttggttgacttcgtccgtgatgccttccttatacgcccagtgtgcagcaaccccgtattcggccacccgatgcatggcttccgtccggatttggaactccagcgggcgcccttcaggtcctaccacggtcgtatgcaacgattggtacatgttggccttaggcatggcaatgtaatctttaaaacgccctggaattggtttccatttagcatggattgcgcctaaaactgcataacagtcccgcaccgtatccgtgattacccgcaccgccaacaaatcataaatctggctaaactgtttatgttggtcaaccattttccgataaattgaatagatgtgtttcggccgaccatagatatccacgtgtttcaagtggaggtcagcaatcgcgtcttctaactcaccaattgccgaattaatatattcttctcgttgagcccgccgcgaattcattaggtggacaatccgataatattgttggggattcaaataacgtaaggcaatgtcttctagctcccatttgatggtgctaattcctaaccgttcggctagtggcgcgtatatttccaacgtttcgtttgaaatccgccgttgcttatccggacgcaaatggcgcaacgtccgcatattgtgcaagcgatcagccaatttaacaatgattacccgtatatcttgtgacatcgctaaaagaagcttccggtgattttcggcaagctgttcttggttggacttatacttaatcttgctgattttagaaacgccgtcaacaatgaccgccacgtcgtgaccaaatagttcctcaacgtcgcccagtgtaatcaacgtatcttctactgtatcgtgtaaaaaaccagacgcaaccgtctccggatccatctttaaattggctaaaatcccggcaacttgaatcgggtgcataatatacggttctcccgattgccgatactgctccttatgaacataggaagcaaagtcacaggccttttgcacaaacgccgtgtgctcttcattcatatattctcggcacatgttcattacgtcattggccgataatactggttctttggacattaacatcaccaccaacctcaaaatacaataaaagcacggtatcgagtggcaacgtgcttcggtcttattgaataaagtatacgtttattataaacaaattgcaatgtttagctattcgataagttataggataatatttcaatacagaaatatacgatagcaaagtaatttgcgtaatgcggcaagatgattattgccccgattaagtataataccggaaataaaaataaaaacataaagtgcaaaccattcgacttaatcaggttaccaaacgtgtagcttgctaaagagttaaacacgattagtagccacaaaacaatcattaccgatggagtatgacataatttcagcacaattggcaaaacaattccaattaaaaacgcaaataaaacgtaacgccagtgggctgaaatctccaaattagcgattttcttcataattcttcccctcactattgcagttcaaattgatatgaaattgccgataacacatacattggtgcgctctcggcccgtaaaatccggggtccgaggccggcaagtgtaaaattagcgtcgttaaacgacttgatttcttcaggagccagtccgccttctgggccaaatactgctaggagcgcatccccgctagccgtatttgataaaacccgcttaaaattagcaaactccccttctttcgcagattcctcataagccaccatccgatgctgcactggtgagttaaccaagtccgcaaaggaaataatttccaccgttggaatcatttgccggtgggactgttcggcagcagccttagcaatttcctcaaagcgttgcaatttgcggtcaattttcttttcattccagcgggcaactgaataacgtgctgtgaaaaactgaaaatgacttgcacccatttccgtgccccgcttaataatttgctcgtttttatcccctttagaaataccacaggcaatggtaacttctaccggcaattccacagatttagtgatctcttgtaccgcctttaagctcgccggcgctgcattatcaagcaactgacttagccaaaccctttgatcactacccactacttcgattttttcaccaatctgtgctcgcattaccttcaataaatggtgcgaatccgccttagaaagtgtgaattcatcttggagtgctaatgcttcgttaataaaatacctttgcatagcagcctcctactcttcaagttggtgtgacgcaattactccgcgccattccccgtaagttagcacttggttaaccttaaagtcatttgccgccaacgtcttttgaatcaatggaagcttgtcatcaataattcccgacataactaaccggccatttttattcaacagcgacttggcttgaggaatcattggcactagtacgtcagacaaaatatttgctacgatgaggtctacgggttgcttaattccctcgaggaggtcgttaggccgcgccgcaattgacttagcgattggattcaagtcaaaattttcttgagcagcggcaattgcatcatcatcgacatcaaaagcttccactttagctgcgcccaataatttagccgcaatgctcaacacgccagagccagttcccacatcgtaaaccgtttcgtttccacgcatgatcatttccattgcttgcaaacatagccgagtcgtcggatgggttcccgttccaaaagcccgtcccggatccaaactaatcaccttttcatccggttgacttgcttggtaatcattccaacttggtttaaccgttaggtaacgggtgatccgcatcggatggtaatattttttccaagcggtagcccaatcatcgtcttgaatctccacggtggttacgctagccgggccaacgtccaacccaaagctgggtaattcattaagctttgcttttaactggccaaccaccttgctaacgtccgtagattccggatagtacgccgaaacaattgccccttccgtaatgtggggaatgtcttttaattcatataattcactcggataagaagcctggtagttcttaaaatctaaggcatcttcaatttttactcctacagcatcaagcccgtcaaaaatactgcttactgcttcaacggccttgttagtagtttttacgtttacctcggtccatttcaaacctgatcagctcctatgttatctcatgttagatactataataccgcatttgactaaaattttcgaaacgtaaagctaattttacccatcaaaaagtctgcagttagaaaagaggaacttaaactaaaaccggggagctggtgacaccactatcaagatggcggtcaaaccaaatttgagtcctaccgccgttttcaagttagccccgaacaaactgtatgctagcaaatctttcttatagacggtaaataaaaatgccttccaagaacttcaattcttgaaaagcattccttctgactaaccacttaattattcaagctgatatttatctttcacttaacgccttttggggaagtactaaatttaaaattattccgagaaccgttgctactgctaatcccgaaaagcttaaatcccctaagttcaagctggcattaccaatcccgattactaaaatcgaagccgcaatcattaaattgcgtttctgattaaaatcaacgtgttcatcaatcaagatccgtaacccattagccgcaatcgttccaaataataggaaactaattccgccaatgactggactcggaatgctttcaatcaaagcgctcaacttgccaataaagctgaaaataatcgcactgactgccgcgcccattaacacgtaaacgctatgtactttggtaacggccaacaccccgatattttctccgtagctggttactggaggaccaccaatgaatcctgccacgatggaagcaaccccgtcccctgacagagtccggtgcagcccaggatccttgaagaagtttcggtgtgtcaaggtatttaaaaccatgatgtgccccatgtgttcggtcatcgtaacgaaggctagtggcatcatactcagaattgctccccagctcaagtgcagacgatagcttacaaaaggaatttcaaaacttggagcgattagccaatgtgcgtgcgccacccccgataaatcaaccgctccgagaatcaacgctacgacgtatccggtaatcaaacctagcaaaatgggaatcaaactaacgaagccctttaagtacatattgaaaacgatcgtaatcaatagggtaattaacgcaattgcaaaatacttaaggtcataaacactttgactacccaccgtacgcatggtggcatcttttgcggccgttcccgccaaggataatccaattaccatgatgattggtcccaccactaccggaggtaaaattcggtccaaccagtccgaacctagctggctaatgatcaaggccacgatcagatacaccactccgacagaaattgttccttgggcaattccctcatatcccgtagttttcatgagcgccatcatcggtacaatgaaggtgaaacttgaacccatgtaagcaggaatcttagccttggtaatcagaatatacagtaatgtacctacccccgaactaaaaagtgcgattccaggatttaagcctaccaaaatcggtactaggactgtagaaccaaacattgcaaacatatgttgaatcgatagtccgactaaatgcggaaacgtagggcattcattaatatccaaaattgcttccggattgcggtactgtccttgcttttgctttgacataacttgcactacttcctttcttaatgcaaaaagcctcttggatccagctgtgatccaagaggctttttgatggttttccccgaattagtcggagtattcaacgagcaattagccttttggcctcacgggaccaaattaaggtttctttaagggataatcatacgcacattcgataaccccgtcaatagtttatttaaaaatttctcgttttactgtaattcggttagcgtttgatatccttgaccccgtcttgctccgtcaaatgtttcttcaaataagcaagcagttcattttcccggtgaaaaatccggggactttgttgtccatgtaaccgcaaatcaatttcattaattttaatccgccctgtccaggtatgggtatacttaataattacccgattattaagttcttccttaccaaatttaaaaacgtacacgctttcaggtgtcatcattgggcgaatatatttcttgctatattgtaactggttactccgtaaaaattgtttgattttctttaaaattgttgaccacctcaccctttttttattttctagtttccgctaattatgattactaattctatcctattccagtctaaaagtaaaatacgccatttctaataaatttattgatttaatcccgctaaatatagttttttaactctattttatttactaatttttctaaaacagttcggctgcttgacgtttttcttcacgagcaaattaataacactatattagtcaacataaataaacacttggggttaccataactatcatcagaacagcttgatatctaaaaacttattcatctttatcaaaacgtcgttcaatacgccgctgattccataaatcaagtttctttagtagctccattacccaaagtcccaagattaaactgctaataaaaaggatcccggtcgccgcaataaagtaaccaattcgacttccctggtagaaatgctggtagcggtggtagttctgataggcatttaaaccagtcaatcccagcgtaaataatagtaggaaacttttttcataacgcccatcaaaaattctaatgccgttaaacagcatccgaaccactacgtaaccatctgctagtactaagtaagccaaaggcctctaccacgtaagacgaccagggcatcttaaaaattgtcatttgtaaggcaattgcaatcgccaatagtgtcagtaagattgttaaagcttcgtaagcaatttggttacggattcgtttaactcgttcatcaacaacgttttttctcatgatgggtcctcccaaaataaatcatccaatgtcttgtctaaagcttgacaaattgctacacataatttgagcgtcgggttatagttacctgcttcaatcaagccaatggtttgtcgagttaccccaatcaagttggccagttcggcttggctaaggtctttttctaaacgagcaatttttaaacgctgatttttcataacccaccaccttttgtaatatatatattgcttgatgcaaattatacattacgcagaaaccgttttcaatggccaataataaaaaaaccactatcagttggatagcggccggttggacatccgtaaatgtccagttattggatgggatatcagagttaatatatggaggcttaagccttccaagttgctagtatagccccaaaatggcagaaaaactagggattttcaataatttgtttcaaaaatgtcacattaaccgttttcaactttcccacattctagtaacttaattttattgattacctattcggctaattccatttagtgttatcataaatcattagagggagattgagaaaccatgagctaagtccagccctttaattttgagctttggtatggccattcgtttttcatctctaactaccaaaggggggcgtcctattcaagattaacgttgatctgaggattggacagtaagtcagcgacaatccggctagtaaaaattaaccattttaatacgaggaggactgcacatgagtgataaagttaacgcactattagaacgcatcaaaccatctgtaaagaatactcaaatggcgcaagtttttaaatacaatgaagaaatttctaaaatcccaggagtaattaagctaacccttggagaacccgacttcaatacccccgagcacgtcaaagaggctggcattcaagccattcgggataacaagagccattacaccgccaccgctggggaccccaaagttcgtcaagcggcagcccaatacttaaaacaaaaatacgatcaagattacgatccagaaaatgaactcgtcattacggctggggttaccggtggaatgtacgccaccctaacgtccatcgttagcgaaggtgacgaagttttaataccaacaccaatttttccattgtacttcccaatcgttaaaactaaccagggaaaaatcgtctacatgaatacggctgaaaataatttcctacttagccctgaacaattggaaaatactctacaagcacatccgcgtgctaaggcaattattctcaacttcccttctaatccaacggggatgacttacactaaagaacaattgaccgctttagcagatattctgcgaaaatatgatattttcgtaattagtgatgaaatctatagcgacttgatttttgatcaaaaacactactcgatttctcatctattaccagatcaaacgattgtgctcaacggcctttctaagtcacatgcaatgactggctggcgagtaggcatcattgccggaccagctccattagttgagcaaattgaaaaaattcacgagctgtcggttaccagcattacgacggttgcccaatacgcggccttggaggcttttcaaaacgggctcaacgatagcgaaccgatgcgcgtagaatacaaaaaacggcgcgattatttgcatgatgccctcgttaagttggggattgaatgcagcaagccgcaaggtaccttctacctgatggctaaaattccgagtgacttagaacaagatgacttcaaattcagtatgcaacttgctaaggaagctaaagtcgccgttatcccgggttctagctttggtcctggtggtgaaggctacgttcgctttagctatgcagcaagtatggacgatctaactaacgcaattgcgcggattgaaaaattcctcaaagctaaacgagcataattaaaaatcgagagctgaggaaacaccaaaaattctttttaaagatagaattttggggaaaataattttggtacgttgccttgatgatagaagcaaacgtacgccaaaagttagtatgttcccgctcagccaaaaggcgaccattatgccaaatccaggcataatggtcgcctttttagttaatgctcaaaccatccaattttgggcccgttcccctgccttttattatggttttaaagcttacctttttgatattgctgtaaataaaaatcaactgtcgctcgtaatcccgcgcgaaactccgtttgtggctgccatcctaattgttgttcgagtaggctggcgtcaattgcgtaccgaaaatcatgcccgggacgatccttaacgtgctgtactagctgcgtatactgttcgaccgatttgcccgtcatttcagctaaaatagctaacaattctcccactagttgttggttgctcaacggatggtcagcacccacgttaaaacgtgcacccgattttgcttgaaaaaccacctgccaaattgcttcacagtgatcactgacgtagagccaatcgcgcacgttctccccggttccatataaggggattggttccccacggagtgcgttaaaaataacctttggaatcaatttttccggatgttggtaaggtccaaaattattactagcgttcgtaattgaaatgggcaccccaaaagttctcccgtaggactgaactaacagatccgcacttgccttagaagccgaatacggactacttggttgataagggctcgcttcagtaaagctccccgtagcccctaagaaaccataaacttcgtccgtacttacttggtgaaaccgtttgtgggtgtaatcccctgcccacaattctttaaactcttcaatgaggttaaacgtaccattaacgttagtggtgataaactttgctggatcggcgatgctctggtccacgtgcgactcggcggcaaaattaattaccacttctggacgaaaatcttggaagatttggcgaacgtgcgaccggtcggtaatgtcgccccggcaaaagtggtaattgctttcttgagagacggtaaggttatctagattagccgcgtaagttagtttgtctaaattcaaaaattcaaatttggggcggcggggcacccacatattcataaaattggcgccaataaagcctgcgcccccggtaactaaaattctcattttttgcttccagcctccaagtttaaaccatttgattttgtggatctaacaccaaggatttcaataacctaaatttatggcgaatcgttggcatcatgcccttgctaattctataagtagttgactaaagcataccggtcgacttatcaagcgtcaactctcctagttcattcttaatgaagggcgttatctttaatttagtaaaggagacttcccacgccattcttttatccgtatggaactccttaatacggcgtgtaaaaaattttattaattatattaaacgggcgttgtcagaaaaaatgataacgcccgcatttatgcataattgttttgaataatccggttatttcactagttcatcaacccatgcagctaagtcttcttcgccaccatgtccagctttcacttgcaaatctccagcccattctttgaaggtcttttcaaaaatccccgtatcaccgccgaacgtgtagaatggcgctaccactccttgatagccttgtaaatccgttaggaaggaatggatgggggttgctggggctccgttccaaactggactacctaccaagattaaatcatacgaactcacatttggaatcgctttcgaaagtggcgggaaatttccggtttccgtttgcttagttgcctgctctgaaacttccgtcatttcctcactaaaggtcccaggagccacttcaatggtgaaccgatccgcagctggaagcaattcgtacagtgctttcgctactttggcagtcgtgcctgtccgtgaatacgttgcaatcaaaactttcttagccatttaaaaaccatcctttctttgtttagcatttcacacctatactataacgctttttaggtactttgcggagtacttttgtaaaacactttacaaactttcggtcattccaaaaccatgtctaggtgcgggatgttatcttctaaatagacatctgaaacgggtttaaagccaaattgcgcataaaaattttgtaagtaactttgcgcagcgattttaaccggtcgaatgcctgccactcgtttaatttcatccagggttacttgaaccaaacgttgtgctaaatgctgcccccgaaactctttaaccacaagcactcggccaaaactaatataatttggatcgtcatgcggaacaattcgagcatatgccaccagccgaccgtttctttcgatcattacatggcgcgcgttctgatctttctcgtcaacttcttgatacggacaattttgttccacgacaaaaactttaactcgttcttgaaaaacttcccataattcggtggaggtcatttccgccgttgttttgattgataacgttaaatcgtctgccattgagttcccctcttccgcaaatttttattattcaagtccagtatactctttctacatcgactaccagaattttaacaaattttacccgaccttttggcaaaattaaacgttcggctgcgtaactttaactaactgacccgcgtcaatttctaaaattgcgtcgtataaatgcgcgtcagcctcgctaagtttatgagtaacgtgaatgcaagtctgctctttaagtgtcataatctctttttcaattgtctgtgcggtaaattgatctagcgcactcgtaaattcgtcaagcaacaatactggtgcttgacgaattaacacccgggcaatcgaaatccgttgtcgttctcctcctgataaagagtttccagcttctttaatgggagtatctaatccttggggaagtttttcaagtaggaattgaagccccgcactctttgccgcagcgacaatttcttgttccggaaaatctttaaacagggtgatgttttcccggatcgtccctgaaaaaataaatacgttttggtggatcatggaaaataaatttaaaaaacttgcatcgctcatctcccgataattatggtcgtctacccacatttcaccgtcataattaggataacaattttgaattaaccgtagtaacgtggatttaccacacccgcttttgccaattattgcgtacttttttcccttttgaaatgcaaaactaaaattttgaattaccgtctttgccccatcataactaaaattaagcttcgctaacgaaatttcttggttaaatgtcccgtgagttgcttgattggcatcatttttaattgtggtattctgaagcatttccgtgatttggttacgcatggttttagtagaattactattatttaccgctaccaacatcatgttgattggattcatcacgctgtttaacaattggacaatggcaattaacgagcccattactaatgcgccagtgatcacaaaccagcccccaagaatcataatagaaaatataatcaggagtactaaattttcgttaattaccttggtgattccctgacgaacgctaaactttagcttcatttcctctaaattatgattgtaacgatcaaactgctcttgcattttatcttgcgcattaaaagaacggaccacctcatatccggcaatcaaatctttagtcttactagtaaatttcaccatgtccttttgaatactagttcgtaaatcattcaatcccatcccagtaaacgacgcggtcgctaagaaaaagccagcaattgctaacaccccgatcgagaattgccagttaatcaccactagtgaaagaatcgcaatcacaaacgttactacggcttgtacaatcaaaaagtaagctttatagtagttatcttcgatcgtggtcatgtcattagtcaaagcggaaatgtactcgccgttgcttttgctaaagtaactttgataatcccgttccataatggtacggtagacgctccgccgtaagtcctccatttcattcttaatataccgggctactaagacctccttcaaataattaattaaaaaataggttgctatgtaaagtatcgaaatgcctattgaacgtttcagagccccaaagtccttattcatcgcacaatctaaaatcatcttcattaaaaatgcaactaaaactaccattattgaagaaagagccgtcattacggttgccaaaaactttaaaattcgatgcctttcgatttccatggtattcctcctatgatgtttgctactttagccgacaaccactacttggacacattgccaagttacacttaattcagtttcgagtatatttggtaacgtaaggtaattagcaagctttgaatagcaaaagaggctgaaaaaaacttttcaaggataaaaaagtccttaaaaagttattttgatattttgacttcaatagagtcaaaacgtgtgccaaaagtcagttggttccgcttaaccaaaaattgaccatcatgcccagttcaggcatcatggtcaattttcagttaatgctcgcaaattatccgacttttgtcccactctctaattattttaatttagcgtaaagccctgttctaataaaaatggggcaacatcagtacgtcgcggttcagcaaaaaaatcggtcattttccgtatccagtcggtctcttgggcatgcgaagtccggttcgcataataagcttgcgtaattttttggtattcactcaaatcttgcgccgcttgccgatcgtaaccatttttgaaagtattattatgcagcggcatccggggcttaaccgcatttttacgcgtaggttttccaactgttatcccaaataacggcaccgtaaatttaggaaggtttagcaaatcgcgtacggttgttaaatcgttgcgaattccgccaatatagcagattcctaagtctaaagactctgcggcaactgccagattttcccccgcaatggcggtatccacgatcgctaccgttagcgcctccatgtttttaattccggctaagtctagaccctgttgttgcaagatttgggattgccgatacagatctgccacaaacacaaaaaaggctccgctttgctttacgtaggcagcactctttgaaatttcagcaagttgtccccggatggacggatccgtcacgtcaataatcgaggtagcttgtacaaagttcgacgaagcacccgcatgcgcagcaattatcagttgttccttaacctcatccgcaagtgatgtgtccgcaaaatttcttacagaggtatgttttttcattaattcaattacgtcttccaatagctttccctcaatccatgcttactatttgtcaataaaaaacgacaatccattatagcactaccctttcaaaaaaatatacccaatcttataagacacaaaaaacctgataattaaaagtgttcgtgactactcttaatcatcaggtctggattgtagaaaaaaacttgtatttttttaaaaatgttttatactaaatgcaagattataattaatcgtcgtcggagttagctcttccaccttttttaccaatttcttggtaaaagtccttgccatgggatttggaagttgcttctccgcctttttttccatttttttggtagaattcttcatcatgagcttctgaagttgcttctccgcccttttcgccgatgtcttggtagaaatccttgtcgtgagtttcagaagttgcctccccgcctttttcaccaatgtcttggtagaaatccttgtcatgcgagtctgcagttgcttcgccaccctttttaccaatgtcttggtagaaatccttgtcgtgtgatttagcggttgcttctccgcccttcttgcctgcttcttcccgagtcatcttttcttcttctttagccatgtttcattcctccttgagttagtttttttctacgagtgttatgttaaatgctttttaaagcgattacaaatttaacgcttggcgatgctcagaaaaaattttagttaaatctatagaatcttctgttaatttatagttatttaggaggaaaattatgagtaactttttattgcgatacctgaagctgatggccattgttttaatactttgtgcctttattttttatgtagttcaaaagcctttaattattagagatttttttaagcgtaacaatttcgatgtgtttcttaggctattacctctaatttttacagccttcaccattttttttacactttctgaatattataatcagaaacaacaagccattgaaaaacaagcctcgttaataagtggatggcctagtaaagttgagaaaaacaagctatacataactttaaataacggctctaaaaacccctgtttttaacgtctttgtggtcaatcaactagcaaacaaacaaacacaacaaaacattgcttatacaagtagctccactatacctattggacaaaccgaagtacaagtttatctacaagatggatatatagatgataagaataaaattccatatatatactttactgatactgatggagaacactggaaacggcaacgtaatggtcgtcttgtacatcttaaaaaagaagatacggaatacgactacgctaaatatctacaaaagcatggggcggtactaccatattctaaggcttttattatacgaacagaaaaataattcattttgcataagttcttcatttgtaactaaacttcttcaaaagtccgcatttgtgggcttttttatattggtaacataagaaataattaatcaaaatcagttaacttttctttttttatttattatttgcttgtataatacggttaaattaaatcaagaaccatcagtctaaaagataatggatccagtataaagtttattctggaagtaatttttatatccttatctactcgatgaccaacaatctgacgtctataaaagctgtacattaatttgggaggaattttacatgaataagttattagacagatttgatccattcatgtttgtcgttggaatcttaagcattttcgttgcggttatttctctaagaaatcctctagcaacctttagtgcggtagtcgttattgcggcaattaccgcgattttgtccgggatttacaaattaaccgtccttagaaatgctttagaaaactctggatgggtggtttttaacgcagttattgatattattatcgggattttaatgttgtttaacggaaaatttgggattttgtttgtcgcaatttcgtttgcaattatgtttttgatggattcgataatatcattgtggctctctaacgttattaaattagttaacgaaaagtattttatggttgacgttattttatccgtaattggtattattttgggcgttcttttactaatttatccagccttttcaatcctatcaatctattacctagtaggattattctttatgattactgggattggtgcgattattcattcgatttaatttgctatttaaattaaatcgcctttcccgctctggtgaccagacacagttcgattctgtgtgcgggaataagtccaaaaattgatgactctaaaagctaagttattttaggagatgatttcttgcaagaagaaactaaagttattcgaattattggccggatggcttccgtactctccgtattgatgtacgtttcatacatcccccaaataatctccaatatgcatggtgattacgggaatcctatccaaccgctagttgctgggattaactgcaccgtttggacaatatacggttatttcaaggctgagcgcgactgaccaattattgtagccaacgtcccggggatctttcttggattctttacgttctatacagcattacattaattcttaaatattttatcagttaaataaaaagtgactaatcttagtggtggtattagtcacttttttatgattacctcattccgttttgaatgatccgcttaacaattattggcgataaagctaacgtaagtacttagtaatcgataaactagcttctggggctttcttaaagtccatacttctcgatgctccgaccattcaaattttgtaacgctcgattattaggagcggcaaatacggcagtatatcggttgagttgttgtaggtcaatcgttggcgcattttcaaataccaaccattccaccccctcggtcaacggaggggtcgtcagggaaccgatgtaccgataaaaatttccgtcttgggggattaattcctctaaaattaacggctgggtcactgctccgtcctccatagcatctaatatcttctcaaactcttcatttttaggacctattttaaatgtaacgctaaccaccagcggttgtttcaaactgccataatgaacaaaatgcgcttctaaaactcgtggctcggcttccccctcaaaacgatgttccgccggatggtgaaagtggacctccattaattgaaagcgacgtcggtcagacttaatttccccattagccgttaaagacaggttattaaggttgttatgtacctccgtagcgacgtacggtttggttctactaattacttggttttgttcgccttctaacccggctttttcaattaagattggtgattgtgtcgtccggccttctttttcccactggtcttggtgattataatttaattttcgcatcgttaatcccttcttcaaatcaattgtacggcgctattttttggcaattaaaagggagaattgctcccccgcttttaatttagcttaatgctatcaattgtaataatcgactacaaacaaccaaaaagccgatttggtcgaaaccaccaaatcggctgagatatttcttgatattgagctattcaaaaattgctgtacttgttagcgttgcgttgcattatcaacctcttagtcacttagccaggctaccagattatcgaggtcgccgatcatgaaaactaaaatactaattcttcatcttagcgaaaagctgcggtaaaatcgttgaacacgcactcagtaagctgatttattaattacatatttttctgattattaagcctgaaatgggaaattttacagcctaatatttgatattcaacaaactattatttttaacgtcttcaattgtcttcgtgcctgctagttgcataacaatctccaattcgtggtttaggtgttcgaataccgactgcactcccttagctccgcctaaagctaatccgtaaattactggacggcctaaagcaactaaatctgctccgctggccaaagctttaaacacatctgaaccccggcgcacgccgctatcaaagataattggtacttgtttgttaaccgcggtagcaatgtcttctaggacgtcaaaagaagcgggtcccccatttaattggcggcctccatggttggatacgtaaattccggcagctccagcatcgattgctcgaatggcatcttcaggagtttgaattcccttaacgattaccggtaaattcgtataatcagcaattcgcttaacatcttccggccgaatgttttgcgcggcagaagcatatatttcttcaattccttttccctgaccatttccttcagaaaacttaattaagttcgccattggcaaagggaatgtgaatttattttttatgtcagcttcccgatatccgtcaacggtggcgtcaacggtcaaaataattgccttaacgttagccttttttgcttcatctaacagactctcgttaaagttccaatccttgctcatgtacagctggaaaaattggggagcgtctccgccagcggcggcagtttcagcaatagatactgatgaataggtactttgcgccattagtccaccaacggctgcaagcccgcgcgcagtatccttttctccttgagaatgtgctagcccctgggcggcagctggagccatcattactggagtattcaaaggaattccaaagatttcagtgtttagctctggcttttcaatcccgcttaaggcctttggggcaatttgtcggtgatgaaacgccattctattttgtttaagagtccactcatcttcagagccaccagcaatgtaaccaaatccacctgctggaattatctcctcagcctgtttttctaaggattccaaattcaaaatatctattttttcttcccgatcactttgttcataaccattaatcattgtcatggtatcttccccccgattaaaaatctaactattctaaaatggcttcataacaaagaatacgctaataattcattgccgttgtcattttacttacttattgtaagtagatttacggttaaatgcaagtgttaatttgatattgatctcctaaccatattttttaggcaaaaaatgggaaagatgacattaagtgtgagaacgaaacatccgcaacacgaacatactaaaaatggtttggtatcgacgaaaacaaaatcagctctatgcagcaaaatttgtgcaaaatcatttattttttagcgttttttctaaacataaaaaaatagaaacgccgatgtaacggcatttctattttttggatattattctaatggtgctaataaggagagtacagatttgaaaactccttataaatgccgttatatcaacactttaatgtgtttaccgcaccactatagcaccacaacaatatagcagtacttcatgtttaaataagcgggcacctatatgggtgctttttatattcttcttgattcggctttttctattttgtatcagtaaatcgtgtcatcaatcgtaatatattagccatgcatgttgcttgcaatgcttctatatttgctttagtattaattttgtgtttttattttgtattaacgatgaattttaccccttaactatataaacctgtctttttcagatatcaaaataaattacacaaacaaaaaatcacacagcctatttctaagctggtgatttcctggcaagcttgatattctttggaggagaacctagcttgcaacttcattgtaatactttatttgtattaaggaaagtccacttaaccaattattggtcgagtggactttttctgtattttaagttattttccgaaataattggcgtaaataagtttttttcctacattggagaataatgatgtcatttcaataaaaaataggagaactcaattcaagaggctactcccccctttagctcttaaactaattctcctactgatgattatcctacacccaaatacactttaaaacaacctgtccagacaacaaaaaagcctccgtccgaagacagaggctaaataattacttcctattgtttatgtttaaaaattactatgatcattaatgctaatctgtagccggtctagtggttcgccatacatgccggcccagctatcatagccagcaactgtaccgttatccgcacatgtaccgagataaccagcacgttgcgtagtttgcgaacggtagtatgcttgctggtacgtctcaccgcttggcgtggtgtagtacatctgcacaccatcaatagtgtggcccttaataccagctacaccgttaactgtatcgttcttatttgctttagttacccatggtaaccagccatcttcaatcgtatggacacggtatttgatggacccacggtttactttgatgtaaagcaaatcgttagctagataaggcgctccagcataaccgttagttcctgaaccgaagttctttacgtccggataccaactgcctcctctttgatgaagtgcgtaggttatatctacctgcttcttattagcgggttttactggtttaggagttggcttaggtgcagggcttacatcattgcccgacgaactaaacccgtattgtacgtcatgggcaaattgagccttggtgatgccatgacttgctagatagccgtaagggtcggtgtggtcaccccaaacgttattggttacccaaaggtgggactttacacctcgccatgccgaactatcgacatcggttggaataccgtatttaacagcacttgaatgtaataaattaacataagccacatagtctttacggaactctgcttgattgtacgtctgcgctagctcaacttgaacaggcgcattagcattagcccacgacccagcgccccacgcttgataaccctcggcaccaactctgtaaatcttgccaccatcaccaacaatatattgaacgtaagcacctgcgttgtaccactcacgtttttcataggcagctacgtttctagctggagcatatactgctgtagcatgtgcaataacaacgttgttgttggttcgcaatgatgaaccttggcttgagttcaaagcgtagctgttatcgattgtgcttgctttagcgttttgacctccgaccaccgcaaacgaaaaggctgctacaattgcagcaacccattttagcttattttttagattcaacgttattatctcccttcggattatttatagctgttgtatcactgattactcccaacatccctaggatggttagcacggtattaataatccctataacgttttgccagtcgactggataagtaaacccaaacatcaccattatttgttgtactagcacaatgcctaaactaatcaatcctgcccatagctttccgtcacgccaattgatattctttacgtttttcattagtagttttcacctttccatattttgttatgcaaatctttgattcgttcatgatgtctatctagtctgcggtcgtgctcgtctactcgcttatctagttccgcaatgctaatccttatttctctcaaattatcattgagtgttttaaaattcttatttaagtcttttacgtcgtcttgaaacggactaaaaacgatgtatttaaaaagcaaactaaccattcctgtcataaaaacaataatagttgtgattgatgcccactctccccagcttagccctagtaatatatgcaagatatcatcttctttcccttgttttggcaaaataaaaacgcctatgatttaggcgctggtttaattaatgaattgtattcatcttgagttaacaatccaccattcaatagcgtttttagattgtcttcggtgtataatccttcttcgtaatattctttaatatatttaaacattatttcatacctcccgctaattttaatagaatttgagcattaaatttatcttgatcttctttttgcttagcttgagtaagcattatttgagcgttgattttatcttgttcacttgggctaatcacgggtggtttgggttctacatagtctgggttctctacaatctcaccatcttttagcatataaaaagttggcttgaagctatcctcaaagtcgtctggaatttcaccgtcatattcaactgttccgtcgatatctcccaacaaaatatagtttgaaatttcgtttttttcatttaacaataatttcattctgtacctcctaaatcacgtagattcctgtgacataaatattatgttcatcattcgacatgacaccagcactcataattgacttagtcgagttttcagtaatcgtcaggctttcggaatcagcggtaaaatctagttcatagaacccaatataatccttacctgtcgcaagattaaaagtagaaaatgatccacttctaccgttagtttgtgtggaagttccttgttggttcgtactcgaataccacttaatggcaagactgaatttatccgccaatttaaagttaaatttaagcgtgcctgattgtgcattacctaaccagatcggtgtcatggttggatactgtacccaaccaccagttgcggtagttccttttccgccggtatgctgaacataactgtacatagcacctgttgaacttcggaaagccacaatatgtctacgtccatccacactggtactgatatggtattcaataatcgaagtatcagtgctattaattggattgtttgttgctgctgaaatttcgtaattaccggaatctagtgttaaaacgtccgttccgtttggtttgtgtgttactttcccggaggcgtttaataacatcaataactgttcctttgttaaaaaaccatttgatttagtagtcgctgatgcgtgagcatttccaccagagccaacatgatgttctagcgttcttcgatttttttctaaattttcgattgcttccaaattctgtacctcctttagtaattaaaatgacgagtggcgaaacgatcatcttctgaaccggctcccactcgcttcaaatcaatagttttggctgtcgtatcaattgaaacaatgtcgaaagcatcttcaagtggtgttccagcatcattccaacgagcatccttaatcattgaatctagtgccgaagatgagcatcgtgtttcgatataattgataccgtttttggtaacattactatccagatgtcgatgaccggataacacacccgcaattaatccagcaccattaaagctatatgacacactaactggaacatcgctattagttccagatgccgagcctgctttaccttctgcaaagccgcttagaatttgatagagaacatcatgattaatcacatgactgtcactagctaaagtcccatcaaccggatgatgtagcgtaattactaccgtagttccttctgaaactttgagtgctgtattggctaaccaatccaattggtcttgttggaatccagaagattcaaagcgatagaatttagctgccttatcttccactgtttctggtagatcatacgaatctaaaccaatcaatcgaatttttttatcagcaaagtctttgtagaaataattactatcaccgtttcgaatctcaccataatcacgaaccgcatttttatacatcgaagcccattcagcatcactaataattaatgacgggtctttgtagccttttgaagcgtgatagttttggtcatggtttcctttaagaacaaacgctggaatcgtagctgatgaagatgctgtggtaaaaaagtcttgtaattctttaacgttcatttttctctcaactgtcggatcattgagcattgcatcgtagctgtttggagtgatcggttcgtctacgttgtcgccattgaacacgaccgcatcagcatttttaattgctgtagcattcagaactttacgcaagcccgaatcccataatggcgttaattttggtaaagaagtagccccgaacgtatcgtaatccgaagccatgttatagtggtaatccgttgcgaagactaaattaaacttagtcttatcaattccagaattagcagtatttagaacattaagcatgtattcaggaatgccaccgtccacatccgtgacgttcatgttttttacgccttcattaaattctgtgatttgttccaatccgatttgaatttcagctttaaaatcagcaaaaaatttatctaaatcggcctgcgtaagcaacccatcagccttaatcttatcttcaagaatcgttaaattaccttcaactgtagccattcttgattctagttgttctaaatcaatatttttattgctgattaaatcagtaattaatttttcccattcaatcaattttgccttgatggtaccttcagtttgttcaatcagaacttcgacacggtccaattccttctgtaactctgaacggaatggttctttgttaacaaacatatctggattgccattgtagacgtggaaccaaatgctaaatgttgaaactctcttcgaatgatctggcgtttccagtcctaggaacccataaaaataaccttcctgtggaaacatcattcctggaaggttcatctttaccatacctaatccgacaatatcatcacgtgaaccggtataacttactggttcaccagtttcagctgtaactttgccatcatcatctaagttaccaacaaagccactcataaacggaactaatccgtcttcaaactgttgagccttacctcgttctaagaatttaactgagaacggaacttgttcgtcaccaacacgggcattgaaaagttcttgaatattgaacgcttcactaacaccattttgttgtttttgtgtatctaacgtaattaatgctgccatctcatacctctctttctaaaactatattgttgccatcccagcaaattgaaacttcgaaattatcatgcaaaatcgtaactaattgttccatgttcaaatgttgttggtctaacctctcagcattagctttctcaagctttttaacatcttctaatttttctaagataattttgtggtctttttttaaggtatcaatatcattttttaatgtagtaacatccttttttaaaccaccttcattagctttaattattatgaaattaccatttaaatctttgcggtaatcaccatctaatccactaccaatattggtcttaatctcactcatgtaacatcactttctttcattgctttcaactccccatcatcatttacggacaaaataaaaacagtcccatttggtgactgcaattttagcttattcgtcattaatttactcattcgctcggcatcgttatccctaaaaataattccgaatggtgtgattacagaataaaaatcagtaccgttggtggaataacctagcgcattaccaccccgtaatccagttgaatcaattccataaccaacaaaagcaccctctttaggttgatttggattagtcggatcaacaactggattattacttttcggttcagtgaccaggtcacctgtcttatccagaccatgaatatcgtccatttgccacaagtcacctttatctggttcagtatcactaacaacccattgataatagtcatcagattctcctttaacaccagcattccaacccgcggataaccagttattggtgaaccctaaaacatcatctggaggtgaatttaaaaacataaatgcaccactggttaatccaagattttcagcattttcgagtgagaacgtaacctcaccatcaattgcttcgtaatcatgatagccatgaatgtacattcctttttctttcgccttagcaataaaattactggcttgagtgtcttgagtgataccatgtgacagtcgaatcactacagcttgaaccccatcagtaactaacttatcccagtcaatattcgtttgtgtttcggataaaactactatgttataaccctgatccaaattggttcacctcctcgtccgtccaggtctcttgaccagatgaattatcagtcgcttgactaatacttgaatttttagtagtttaaatgttcttattacgagatttttcataatcaagaatcgtcttagccgtttggttcaaagtaattgacgtacgactagtcttactaaacgggtggtactcataaccaacaactcccatattagacacaaattgtttaggtcgaatctctaaacgaattatgtcacctggagtcactggatcattattatcagctgtcgctttaatgcttaaagttggatctggttttaattgagtaagtacccattttttcatctcatctttattcttaatggtgtcactagaaacatcaccgcccggatgtaatccccattttttgatagattcatcatcttgaacgatgaatggttcaaagtaattttcggtggttgttgtcgatgtggttgcatcttcaccactgttatcatcgttgtttccactatcattattatcagcaactatcttagctatatcatcattacgagcaatccatgaaggcggatagtaactgattggttccattcgacaagattgaccaggttgcggttcgtaaatcatcgttttagaatccaatgctaaagcaacatgatgacttgaaccgtatgcaccatagaacaacatatcaccaatttgcggtgtgcttaccgtgtgtccgtatttttccatcgaaaccgtgtaagctgggatattaataccgaaatcataataaacttgtgaaacgaagccagagcaatccatcccagccctaggattagatttattatggccaccccaaacatacggtacaccgagatatttcttagcatccgcaatcacttttttagcaccagtaccagcaaccgtcgtcttttcgtgaataatcgaatcacgtcttcggctacctgttggaccccaaccacctaatttcatatcagtttcccaattactattattgaagaatgccaatagttgatgaaaccctttaagaatattggtataaggtttgaccatgtacgcattaaaagttgattgaataaattgaactaaccctttgctggggtgtccagctgctgcattcgaatcactattattaacaactgtttcactaccgccagattcatgctggattaagtctttgattttatttacattcgcatcgctaattttgactcccatcaatttagcggcataacgaatcgctggaccccaatcaccgttaacagcggttgtatcaccacttaacttcgaagaatcaccagttgtaacggtcttttcaaaagttggaccaactgctctaacttgattgacgatatcagtgctatcgtattcaaagttaatctctgaagcactattaagataatcaattcggtgaccgtaatttttaaaaaagttgtctcgagtatatactttgataactctaccgactggataaattacacaatcagaccacaattctaaaatcttagataaagcatccttagcggaacagttacctaaatcagtaattttttgctttgaaaaattaccaattacgttgtaactaaaacctaatttattatctttaaagaaatattccagaatatcagtcggagtgtaattcgcatcccctttttttactttacgttggtaaatttgaccaacttcgctataaacgtgcgtagctgaaatactaagcgtttcaatgccttgtgaataatctggtgtggcttgcttaataacgtattcagaaccatcgtatttaatcgtattttcaactgacaaattagcataagctggactgccatcattccatgtcgttagtgataatttaaaatctccattcatttcccacgtaatagcaaagctatctggaacaaatgaagttaagcgatcaatactggagctatttttcgcttgaataagaactggttttgtcatgatagataaatgaatggaaaactaaaggtaatatcaaccgaggttgctccagtaacttcgatgtcattattaccaatttctaattccagattctgaaaattagtatctgaattacaatttttaccattaaaaaaactattaaccccatcaagagtaatagtatctttaccatctgattttttattgtaagaccaaacagtaccgttagtcttattcgtaatcttcaaagaattaccagtaaacttactaattatctttaaatcgtgacgctttaaatacggatcgattttaatatccgaagcgttgtaaaccttaaacttagtcgttgtaaaatgataagtcggattaccttcagctaaaaggttcattcctagttgccaaccattttgttcaaacgtgtaaggcgaatcagagcgatacattgaatatcgataaccactcggattatcgaacggaatcgtaaacaatgcattatggtcacccacactaatcggagctatctcaaatggtgttggatagacgaaataaaccttggctggatcggtgctagtccgaatccgaattaattgacgataaccaaacagtctgtaaatctcatgctttaataatttgaaatcagtgtaatctcggtactgtaaccaaaaattagcattcaccgttgacctagcgaatgtttgataagcaaacggcgaaccatcaaggttagcaatatcttgatacgtattggtaaattgtggtgttgaatcttcagaacgaaacagcaatcccttaattcgttgactgatttcaaattcatcctggtcaccaatcttcatccagaattttggtttcataaattcacctcctaacttgatggaccatacatacttaatgacaagtccttagcttctttgcgatataatccatcaacatcaaaactaccttgtcgcattaccgcttgtaattgagctcggttaatcgtaagtaattcaccaaaagtgctactcatcgtatcaaacttatcacctaatgctttaactaacttctggtcactgtcgttgaccgtattaataacagtagattgtggagcaacggattcactaatactatccgaagctttaatgatgcttgaagattctggaatagtaggacttactagcttttgtcctttaatcatgttcgcagttagtcgagccggaataatctgactacctctaggcaagtcttcaattacaacatttcttccctccggaacaaatgctcggcgaccaggtatcttaattgcttcacgatagactggaccagcctgatcattaactaatgctgaaccaccttggaagtttgacgtacctttttcaaaaccaattgagtgccacaatttagcagcacccgatttaaccgccttgaataaagcagtaatcgtaacttctttgcctttaacactatcaattgacctcttagctgaagtaacaccaccgctagttttattgctagcagtgatagatttattacttggcatcttcataaatccattaactgtgcctttagaactggtaacaccgcttttagtattattagctgttgttaaaggtttcttaccgttcatactagtaaagcctttaaccgatgtctttgaactattaacaccactattagtgttgtttttagcggtcaatgaaacagatttaggttttgagttaccaaaatctttaacattctttttagctgttttggctggaccagaagctttatcggttgcttttaatccaatcggattaggcattttaattcgaccatatttatcgactgcaattttcgcattgttagcaggctttgatgcgttgtctttagctaataagctcttaacttcactctttggtaaactaatatactttttataatcattggtaactttaccaacaatctgactagcatttttatcatttgcgattaaattcttttctttggttggaagactattccaatcttttacgttcttaacgcctttagctacatcactagcacctttagctttagccacaaccgtcttcatatgtggtgtaaggttattccactgattaagtccaattttagcttgcttcattgctggagaagcattgtcttttaagacagctttcttttcatcaacgcttaacttattccaagtcttaagatttgaaagtgcgtttaataaatcagacttacctttagccgaaataattgctttcttttcagctggagtgaatttgttccactctttacccttttcaatcattgcagctaaatcatcgccacccttagtagcgattaaagccttcttctctttaagggttagtttgtcccacttgccagcattaactgatgcaattccgatcattgaagccgcattggtactcatttttccttccttgaccagaagcatcattgagttccacttatctttgttcttaacggctttatcaacttctgcttgagcattggtttttaacttaccagtctttggatcaagcaccatatcattccatgacttagcagccttttgagtctcttttgacatatcgcctgtaagcttaattgctgtactagcagtatctttaaggctcttggtatactcttgcatcgctttttgagcttgcttatcagtaaaaccattggcttctaaatcttgaagaatctcactctttgacttaccctgttctttttcagttcgtattaaatcttcacctaattgagtaagtgtagcattatgagttttagttaaagcttcttcagcggcattcgcttctttcgcagtaatcaacccatcttttcgagcttgattgattttcccgtatttcttgttataagtgtcgatttctttgtatgctgcatcaccaacatctttagcagtttgtgctaactgctttttggtcatggtaccagtctcaccaagttctgctgctaaaactgattttttctgactagctttaagatttaaagtttcaatctcatctttagccattttgcgttgtaagttcgcaatcgctgttgcttgatcagatgttaactttactccatctttagcagattgagctgtaatatcgctaacttttttcgcagttgattgcatatcagcaatacgtttttgatcagcggtacgttctttattagcttgatctaataaagtttgaccagcagtaccacctaattgtttagcaagtttttcggcttctttatacttcttatcaacgctcttagtcgttgaatcaaccatatcttgaaaagctttatcaacttctttagcactttttttagcattggtattgaaactgtctaacgctgttgaagctttagtttcaaagttactcatatcagttgctgcatctgatacagttttaccaatatcagatccccattcttgcgcacgttgagagctctcgtaagctttcttgccataaagttcccaataaccagcaccaactaaagctgcaactccaacaccagtaacggcggcaccagctacagtcaatgatgttccaagtacaccagcaccagcttctgtggtcgttaaagctgtaccaaatatgcttaacccacctttgctagcaacagatgctttagtagctaatccttcaacttctttaccagctgtagtagctcctgtagcaacatcacctaatacttctttagtcgcttgtgttttggctttccattctgcaaatttaccaaccgcagtaacaatcaatccaccaactttaccaaatccaccaattaacttaccagtcatcgctaggactggaccgccagcagctgcaagtaatgcaaatttgataattgtattttgagttgaatcgtctaagtcagagaaaccatcaactaaatccttagctttattaactaatggaattaatttaggaacaagtttagctcctacttcaatacctagaacttgtaatgaagccaataattttttgacgttattttctgaagtattactcatttcttcagcttgtttcttagtcgcacccgttgagtcttcagtgtctttagtcaattgacgtaatttacttgatccagtttctagcaaggcattcatcgctgattgattttcacgaccaaaagccgttgcaatagctttgtttcggtcagctttgtcccaacctttagtacctttagtaatgtcatcgattaaacgtggtaagtcattagcatctttcttaagttcaccagctgaaattcccatagaactaaatgctttggaagcattcggagtaactttaaccaacgatgttaaaattcctcgtaagttagtaccagccttttgaccttcaatacctttatttgagagttcaccaattgcagcagctgtttcttgaacagataatccagcggcatgtgcctgtggaccaacatacgacatagcttcacccatatcactaaatccagcagcagttgcattagctgcgtaagtgattgagtctgtaaccatttgagtattcttcaaagttccagctgtttacttagatttaagcccaaattgttcaacaattgaagatgtagtattcaaaacagaacctaaatcttcgccagaagccattgtggcatccatgattgaaggcatggaacctaatacttgattagtgttgtaaccacgacgaatcaattcagtcataccattattaatttcagtcgtagacactccatacttctccgacatgctcttagaagcatcaccaagttggtcaagttgagctttgtacttagatgtaactgttgcaccattcgtcagtaaaggaccaatagccttaatttgagaatcaaactgaacagcggatttagttgcataagctagcccagcagcaattggcatacttactttggtagtcatttttgacccgatgttactcattgaagttccaacagtaactgctgctttactcatcttattgagttgaccagtatagcctgtagtttcagctctgactttagccaatgctccggcattattaatgtattgagttcttaaagacattaatttagcatttgcattttgtgattcagttgccaatttagcggttgatttacttgccttaccgtcaactaaagaatttttataagccttacctaaagcttgaacttgacgttcttgtgacatcattactttagataaaccagttgcttttgctgatagaacatcaaactctttaccaaacatcttagcaaccgacattgatgacttaagttcagccattgcatacttggtttcttttttaactccagctagacctttaccaaaatcagagtgatcaagtcctaactcgatgaccattctacctaatggttcatctgccatttatttttacctcctttcctcaattattgttttgccaaatcaaaaagactcataacgggagcatcacctggatcaactcccatgattccaggagttacttttacaccagattgtgtcgtttgagtcttcttactttcttttttggatgtagcatccataatttgttgtaatgttttaaaatcaatatcattcataacggaaccgagcgtataacctggtcgattttcaacaatcaaaccaaccgctgctaaaactctctcacgagcttcacttatggttaatcgttcttcggttccgtcttcacgttttttggatctacaccagcaatttgattgagaatattttccaaagtgtctccaaatgttaatgcattgaggccatcccaaattgtatcttcagtaactgccttatcggtaaatacatcagcaataaaatgaacacgctcgttgtacatgtctcgaatgcttttttctccctcaaaatcaatcaaatctaatgcaccaataattacgttcgctggaatgaaatcctcaacaaatgtttttttcttacctttaatcaataatgttaatttcaatggttcagacataaatcattcctccatattaaaaagcaaggctagattctcgatctaaccttgcttaatcttatttagtcgttacagtgatagatactgtagaatcatcagttaatgtggcagttccaccagtaaccgaaccatcagttaattcaagttcgattgctttaactgatgcacctgttgcgccatcggcacctttatcaccctttggtccagttggacccgcaggacccgttgctcctgcatcccctttcggaccctgttcaccatcgccgactgctgctaaatcattttcgattgcattcaatttagtagccgtgattgtatctcccgttttccattcgttagcagtatgtgccatttaaatcactccttacgcaatttttgcttgaccaacttttgctgtttcaactttgtcatctggatcagtatcactaccgttctttggattgaatagttgatcttcgaagattgtgatagcgtctgaatctgtatttgtattaccaataaacttctgcattgattcaccattagtttcatcggcagcagttgaagaaccaggtgtgaagttccacgtttcagcttctggagtgtaagcttttgaggaatcaagtgtttggaaattgattttctcacgtccaaagttacctgtatagaatccaactaatgcaatctcaccggtgtcctcttttgtttccatttcaattgcacaaagaggtggcatcgtgtcttcaccagcataagcaataccatttttatcaactcgaaaaccagatagaatatctgcagtcttttcaggcaaatctaaaataccaagttgagctttgatatcatcaacgcctccacgagcaacatagtaatcaacattagaagcagaaactttagttgaatcttttgttagtccactaatttctgctgtagtagtaccaccttcatgttttttaccttcaacgataatcaaatcgcatttcttagttccgtcttcattaaatggttgaatttttaatcttttatatccaacaaacatatatctttcctcctaataatttgtgtcatatagattcgtgtttccacgatatctacgtgcatcaacaaaatgaccggtggtttcaaagtattcgtcgagtccatcggtcatttgtccataatttagtttttgcatttcttctttaatttcatgttgcactaatttagcttcttttcggtctggtgattcgacagcaatttgaaaagtaaattcaatctgcatatcgatgtcactagccgaattaccagatattggtggggctaacggttgaatcaaaataaatgttctactctgatctgatgtttctgggtaatcatattttttaatacgatagccaccgttagcagtcttagttaaactagcgatcgttggattattctttaatgcttcataaataattccaatcatatctttgagttcgatcatagtaatttctccagttcatgacgttccagtgatttggcagcatttcttgaagaatcaaaagtcttctgaatcttgccaattccatttggactgtatcttttaccgtagcgagtgtacccaaattcatttaaatgaactaaacggtatctttgcccgctaccagaaccggaccaaccaacattaatcgttctaactccaccacgaagacgaggtttaccagtggtaacttcaattactgttttcccagtatcacgataagacgatacggcattcttcaaattgacagccattaatcgaccagcaatccgaagtgcttcattttcaatcttagccaacctactaggtttaaatttctcttctaatttagcaagaacctcgtctactcctcgtacatcaacactcatgcggtcacccccaaaacaacaatcacgaaacggtcatcttcgaaatctggacgaacgtccaaaatgttccaaagaatataattcccattagaatctttatacctgtaatcagtaataacaacggaatcgttataagctggctggtactcacctctggtatctcgaacctttattgtgacccctcgtttaactccatgcacatctaagattgcattgtccttattgcttgagccataaacttgagcaaaacaatcaaacactggttcagttggcatttgaccaggttcaccatctggattttcagtttgatgataaaaactgactggaatccgtaagtcaccactagtcgtttttggtttctgatattgactcatcatcatcatcacctgccccaaacgttaaactagccgatacacctaaaatttgactttgaaaattaccttcgaagaactcaactgaatcgttataaacatacctagaacgttcaataactaagctttgaactccctcgttggtaagattgtcactaccagtcattcgcttaatttcagacttagactcttccaaaatcgattttaaattttcatcttctgaatcatgaaaaatgtgtaatcgtgatttaaatttttttagtaagttatcatctaccatcacatcacctcgttaaccagtgctaacaagtcagattttttagaaattccatcatgcttaatctcatgttcatctaaccaacttgtgatttcagcaatggtgtttttgctagaaacgccgtcttttaacggcgactctattttcccgtgttaccaccagttgttgggtcagttggtgctgaaccagtgccagataatttcaagtcataaacagccgatgcagtattgtcatgtgctttaccataaaggaattgtttagcagtaaagagatctaaatcttccaaagccaaagtttgatcaaattgcttaatttgaagtggaccggcttggaatgcatcgtaacgatctggaataaacgcaatcactttaccttctggtacgaattccgattcaacagttgttagtccaaatggcattgctgtaacaaattgaccgttcaagttttgaatcatgaattgagcttcaacatccaatgtatcaccaggggacattgccaaaactgttcgacctttagcaactactggatgaccgttttctttcttggaaagtcctttaattactcctgctaattctttggcagccgttttagtatccgcaaaagttagttcaccagcagacgctttttcaggataagcaccgtctgtaacggctacgccttttgaaacatcacgatttaaaccgattggtttatctttaccatctccagtcaagaatgcttcttctgacgctacagcaaaggcttctgtaatttgagttacaacaaacttcttaatccattgtggtccaaagtcttctaaatcctttggaacaacaacgaacgcagttgctttgttttgagttgcatcgtcttcagagaagctggcatctaattggctcttaatttcaccaaagattttgccccatacaaccgttccagtcgtatcagatttgataatttttaggctaataccattgtttttaagaccgattgcagataagaatgggtgttgttgaaccatatcttcaaagatttcatcaaccgttgtttgtggcagaatcttttcgccagtggacttagtatctgtatccgtcttgagttcgttaaagaacttaacctcttcgttagtcatctgcatttgatgagcattttcaagttcagtcatcttttgttccgtgatggacttaacttcgtttttagcatcgctaccaagcgcgtccatcatgttatttaaagccgtttctttggcttcactagttgcttctggatccatggcaatttttgcgtaattggcacgctctttagcaaagtttttgtaatcaccaaatttaatcatgtatattttcctcttttctttatattaaaaaacgaacggatcaatattgacctgttcgtttttagacttatgcgtatctacattttttaattttttcacaacttcgtcagcaacgtctttcactaaatcagatgaaatcggtgcatctaaggcaactgtggcaaatttatcgattaccgtttggggaatcattcctgaattactattttcaaataatggcgcttcttctgtattatcatttttaaaattaattacagaatcaattaacccggcttctaaagcttcatcagcagtatagaaactggtttttgccatgatattaagaacttctttttcactcttgcctgtcttccccatgtaagcttgagcaatcgatttgtctgttcctttcagaacgtcagaaatcttgtcgaagtcattatgatttccttcgccataagtagatgaattatgaatcatcatccttgccgttggggacatctccaaagtatcggcacccatggcaattaccgaagcagcgcttgctgccattccataaatcttagccgttatttttccagaataagatttaagtgacgtccaaatatcactagcggcatatacatctcctccattcgaattaataatcaattcgacatcggctgtttgcccagaaagttcatcattaattacagatggtgacgtataaggtaaattaaaatactcataaaacgccgaatttccgtcagagataatgggtcctttaacatcaatcttcactgtcatctttctcacctcccttcgtatcagtcgtgtagttcttagtgataatcactcggtctccatctggcaatggctctaatcccatagcttcacggacttcattaattttcacgacgccacttgaagccaacttatcaacctgctctgataactcaagaatgttaggttgatcaagtccaaccgcttcaatgtacgcatcacccgacaatacttcgtttttactaaataacttagcattcagttcatcccgaatctttttcagcaacggagaaaggcagtaacgattaaacaacgttgtattctcattgctttcaacattcgtcccatggattaacgctgttggaacaccgataataccagcaatatcatcaataaacgcatccttgacttgattaatttcatcaaagttttgattctttgctgtactattacctagttcttcatagtcgaagcctttagttgttggaataatcgccacggacttcttctcaaacgaagcatagatgttatcaatataattctgtaaggctttctgtttagcctcctgcgttccagttgtcatattcgctttaacgttcgctcgaatctgattattacggagctgaagattaaacattcgtcccattagttcaccataatctgaccagagtccgtttagataactatccaaacgagcattcccgtacgttaaataaattacatcgtccatgctaaacgttcgttcaaactcataatttttgactaccactccgctaaaagagtccggatataacgcatattcatttctgataaaactatcagcaatcaataaatcatttgtatcactctgaacaattaatacttcacctttacgcaataacttgtagactgcttcttgccagaagtcaccagctgatttatcggtattcggtcgtacatttaaatgataataagcttcatccttaaccggtttgtgattttttagtattcgaaattccgtctgaccaaccgctctagcaacaaagttgattacttcatcaatggccaaacgtttcatgtacgcacgttccgccgtactctcgtattcctcaaggtcataaataaaacttgaatcatgacgtcgtgtaaatatttccgcaaagctactaaacacactcatacgctcacctcccttcagctagaaattaagtccattcaataaatcgagtgattcttccggatcaacatcctcaatctcatcaacccgatattgaccatactcaaatgctttaaatccgtcggtttttcgacggcgttcttctttcttgccatactttttattaccacgggcatcaaccgttactaatacattttgtgtattccaacgaagcagagggttatcaccccatacaaatttgttagcagcaaagccgtcttcaattcgaggagctaataatccatcgattgccgttggatttttaattacgtcaacttcgaaatcagcatcttcaaagaatttccttaataaatcagctcggaagttatcaagaacgaccttatcaatcacgtatttctcacgcatctcggtaaaccaattgacaacctcacggggatcaattgtttcagtatttagaattgttaatagtccttgatcttcccaatctccaattggggcaacgttacgaggccgatcagctggattcgctgaatatccataatacttatcaacaaattgcttacgagcaaactgatgcgagataaagtagaccttgccgcccattttgaaagttaaaccgcaagcagcaaaatctcgcatactggcaaaatcaagtgagccaactgcctctcgaccttctaattgatcaagtggaattggttcattggttgctttaatttgctcatatggagcgaccgacttttcaggatcctttaatggtaaatccattcgtttagttagaaattcttctcgcatgctgggctgggactgcatctttagatactgcttccgaatctttcggaataatgtcttaccataaccagttaggggtttagaaagcattggattggctttttcccacatggtttcgtcatcaacttcctcttcagaatctaatttgcaccagaatggaaacatagtatccggcggtagtttaccaaccataacctgtaaagcaatatccttcttctcgtccagatagccgtcacgaacatatccatccgatccaatttcaaattgccgagattcgggtaccttacctaatccagactcgtaaaccgaaactcctgaatcgtcctgatacatgtgaatttcatcaaacacatcaaagccatcacgcaaaccatctttggttttcccattagatgtttgatacatcacaattgaattagttgcttttgattcaatctgcgatttattcgcattaaacgaaccactgagtacgtcatttcttttaactacattgtagatttcagtaatcgaagttttagcctggtcttccgaattagccacaatcgaaccattgtaaccaggtattccatttaattggctaattaaaaatgcccccagtgaactgatcgttccattcttaccagcaccacgcccaaccacccaaaaatactcatcataatacacatcatctgtggtcttatcataaagaaaaatgaatgctgctaaaaatctctgatataaaactgtcggaaaaaaccatttttccgtaaagttaatataatcttcaattttttcttcgttgaaaaaaagctggtcgttatttaggacaaacttctccaaataatcaatcagcatcactcgttctttgtttagttttatttttcccgttttataggcgtttatatagtcatctacgtacttttgatgaatcatactagcccgcctttactattacttgagggggcattttgggcgtgatttccgatagtgttttcagttgatttaatcgtcttaaaaatctcattttccaaatttaaaagttgagtattcaacttctctttttctggaattgctggattaaccttagtaaatttttgattaccattctcaactgtaatggtggctccgtccttttgtatcgctgttcctagctttttatataatttttttaaatccaaatagcgactgattttttcttgcaatagaatgttgtcttggtcactattatttttaaaatattcttcaatttttgataaactcaaactccccaccccccctcgttttaatttttttcttttttctgggaagtcgagctcacccaccggttctcaatttcaatttttttactaaaatttttgaccccgggggatgatttttaatttttatttttgaaatttagttaaaaatgcctgccaatcaaaaaatacacatttttgtacataataataaccatcaaagttatcaatatcgttgattctcttcttgacatagttcttcgcgcgtcgttcgctaaagtagacccgattagcttctgtgatgttagcttgtggttgtcgcattactacatagacaatgacctgcttagtaccatcgactcttggcttcattgtgatctacctccactatcttctgatgattgcaatgattgcatgagtaacaacgatagatacaactattagcactcatcaatccttgatagatataactatgaccagtgaacatacacttcagtcccatcgttcatcatccttccacttattagtacgtttaccattaccattactacgatagttcattcgaccatgtcgtttgttatgacagtccttacataatgttcttaggttgtccttatcaaaccgaagctctggatagtactcaagctctttgatatggtcaacctctagcactgtatccatatcagtaaccacccgaccatcagtcttacaccactgacactcatggttgtctcgatctaatatgtcatcacgtaactgtcgccactcaatcgagttatagaactctcgacgttgttccttgtctaacttagattgcataactaatcgcccaagtgatatttattaccgtacattgtctggcctgttctattatcaatcattacatgcttaactaccgatccatcaatatattcagcaatcagcatattaactccaagattaatatcatcagttaggtattgatatgatagatgtacaatcggatagctcttaccatgaaccatcaacgttggtgcttgaccttgctcaacaattaataagacttcttctgacttatacttctcaagtactttagtaaagtcatctgcgttcaacgatatctttccaactatttctgccatatattttccttcctattccataataaaaagtcacacagaatggtgactgtatgacttattctaagtaaaatctatataaaaattatcccttatccatggtaaattgtctgatggattaataaaattaaaatatttatcactagcaactgacacggttatgtttgaatcaactgaattattatagtctggtatgatgaccgaaccgttatattctagatattcgtgtgcatcttcaggctcgaaagctaagtttattaatctttcatcagtctctcccacaggaggatatgcaaatacacgtggtccttcaggcaagaaacgatagaaattagataaaaaattagataatttgtaaacattttctccataaatttcagaaggatacgaaaataaagtatttatcatattagaataaacctgacttgcatcggtaacattattaaatttcttaccaataatattagcagtaaaacctttttttactttgtatgagtttaatatcactgcttgatttttattatcgtcaacttgatatcttatctctttaaaagtttgcaaaggattattcgataaatagaatactgactctccaggttcattaagtcttccatacgtttttactaatttagcaggtgcctcccaaaattcagattctttccagtgtccagcatcctttaaatttgctatcgaaacacctatgagtcgtgacctaagaagtatgcttccaacttcccacctgcctgtaccaaatatcattctaaattgcttcggtaaaagatcattaaattccgtagaagaaagattcgatacattttttaatacatagttggctttccttaatgcttcctctatcgtttcttccttatatccaggtatatcaaacctgctagtaatatatttttttataaattttttattccttttcaaattaaatcctccaacacacaaaaatagacctacctaagtaagtctatcaaatatacgcagatattaaaaagtcacacaacaattaagttatgtgactcgtgtttaataagatagcaaggaatcgaaccttgccacaaacgtacatgactttccgaattgaatttgttgaaacggaagtttgtggaaccatctatctcactcgaaagattgtataatatcggcatattggaggaaccttagttatttaattctttcgataatactaatatacatgtagttgtggtcgctatgtggtcgctatgtggtcgctcattggtcgctaatcggtcgctttagtgctcttaaatcatctacatctgcaaacgcccacgcaaattgtaaaaatgcttcactcaatatctcctgtgctcgtgttttcccgtaccccgttaactgctctatctcgtaccacattagttgcttaaagtaacgtagctctaacatgcgtcgatgcttatgatctaagccaccacaagctttaactaccttgcttagaatatccttcgcatacacatgtaatgtaactttagcttccgccccattatcagtactatgagatactggcatgccactaattactggcgatttaatatcgacaaatgtagtatgtgccatgttctgcaatgttgggaattctttctcaaaaaaatatttaactttttctatggtcttagcttcatctaattctggtaataatgacacgccctcagctcccgtagtataataatatttgttagatatattgctacgaagcgttcctctatgagggatgcttttttattacctttgaatctcaatgtcaaatcccactgccagcttgctaacataaatggttttaacaacatattctggtaattcttctttagtcatcagcttccacctcttctagattaattttataagctttgccaccgattttttctgcaatctttttcacatcatcaaaactttcactcaaaattgcgtcgtttaagttatcagtcattgtgtatcgataatcgtttgttatacttaattctcttcccttataatataaatctcctagcctaattacataaacgtttttcattagttaatcctccgttttattacttggtagctttttaattttaattagggcttccacagctttttcccaggtcaaatagccaagtacatcattagtaattggtgtaccgtattctagatcgccctctgggttaacactaaaatctaacacagctaattccaacccataactacctggagcgtatatcaggcttgcaccataatcattaggaaatctatatttattttgtaatcccacagttgcacgacttttaggaatttcgtattttgaaaattcatttaattttgtaatcggatttatttcagtcattttctacctcctcaaactcaagcaatccggcattataataaatttcaaactccggccacttttctttagcttcctctactgtaagagcaccacccgtaattccatcactgcctgcaaggcctaaaattacctttccttcatcatctaatcgaacgtacttcctaagaccgtgtatcccttttaacttaactacacgtcttggcttttcaacttcatatccactggcaattgcactgagcaatagttgctgatgcttttcatattttagccaatcaaaatctgaaaccctggacctaacttttttatcaatcaaacatactatttccataggattaactttatgttcatttgcctcttctatccaattagctacaaattttggaataactactttcttttcttgcaaattttctaaaagttcaattgcgtactcacaacctgaggcatacccgtctgcatactccccatccgcagggccttccatataatctgaatatgcttccaccatgcgctttgttagctcttctttaacttcttcaacatccactattaatcgccctccttaaatctctttaatactggcttaaattgctcttctagtcggtccaattcatctaaatattgcgacaattccatcacatcattattgtcacggatcattaaatgaatggcggcgttaagagcgtgtctgatactcggatagaagccaagttgcttcatgacaggtaaattgtccttgtctaatttaatcgccccagaatcatctctgatgaacttaatcaaggtgtgattgttgttgttctcgattttaatctggtaatcttcgttaattttgataatcaattttcttcctccaataattctgtgttagtgtgaacatttccaataacttcatacgttcggtacttgccgcttgtccaaatttcgtactcatcagttgcagtttcatagcaccacccagcactaattttgctacgtttgactactccaattttaggcgactcgaatgtctgaccattcggtttagaagtaataatatcgccctcgtaaatttccttgccattgacatctttcaggccggtaaactgctcaaaatcaactaaatcattcaattgtttcaaactaaatgttgattttttagaatgaaccatttgttgaattgtcatcggcttaacgtagtcgtaagtttcaatccctgtttttatccacgctctaaacttaatcatcgacgccatctccttaattgtcattagatttcctccggttcaaattccacatcgatacccaccttcgccatatcgatcgcaatttcttcagcttcctttaacgctgcttctttttcagcaaatagcttggcttcttctttcggtgcattccatgacacttgattcatgtagcctttatcatgtttatttttcagtacgtagaacttgtgttgcttaactttaaaattgacctgctcaccgatcggactaattgccgcgtgcaaaatgtcggctttctgtttggctcgtttccactttctaaataccgtggcatcttcaatacctacgtactggtgggcctgtcctcctagcctacgataatatttgttagttgctgtgttcttaatcacgtacatctttttcaatctcctttttccgccaatgttcctgttcgtcgactactactttttaaatacgttttaagtcttcaatcgtgtaattattgccgtagatttctctaacaatttcctctgccgtcataactcttcaacctccatttcaactctaggctcttcggcatacatcttatccatctcgacgctcacaatctggttgtcatcatgccagacaacgcctgtgcacgcgtctgttaccgccttaaacaagttatctatgtccggtttaaaaatgggtctatggttattagaaagccttctattacgttcggcttttgacacacttttctgaacagaacgataaaacgtagtcttaactttcaacgcgcccataagtggttcgcctttgtattgttttcttacggtcaaatgtgcattgtccttatatgccttgtatttcggtgcaatgtacgcccatcctttccgcgtcacccttggtctactagcggctactggctcaccgtcaatcactaacttaatcacttgagggcaccttctttttgcatactttgtaccaatggctagcaacgttatatcctgtcatgcctaatttttcggcaatttcatcaaactttgcacccttgcttctttcggcaatcagaaacgcatcttcctttttagtccacttcttaggtgttcttttgttcttctcctttttaatttcgattccgagttctcgcaaatctgaatagatcgtctgaacctctacacctagcttccatgcaatgtcagcataactaaggttcctatcaagcatttctggtattaggctctgccgggcaaccttcatcttgtgcttcgtcattctaatctcgccaatatacttacgctttttaatttttgagatggtcaatccacgagctttgcggaaaccttcgtagtcgccacggtctaacaattcttgttcaatatcggattgcttagcagccgtaccaactcgtacatagcgcatcggttccggcatgtccatgtaaacgctatccttacggtcaccctcatattttgtgtagttcttaagcatccacttatgcaggtccgacttatgttcgctttcgccgtatacttccttgctattaaccccgaccaaacgccacattagcttcacgctccttttcctttcgaaatgccttattacaattagggcagggcatcacctgcataattgctccattcgtttggtacacgacctgcgtaccgccacataatttacacattagaaaatcgccatccttttatcttctgttttttcaaatttgataatcgcgtcgttcttaacgacacctttgtacatccgacttaataattttggattatatatttccgataattccttactgctcaaattagtagtgataattgtccggctccgcttgtttaagacgccgaaaagcacttgctgtacatattcactcgcttctcttgattcgcgcctaaacgaggcctcactgcccaaatcgtccaatacaagcaagctaaccttcccgagcaggtccaccatgcgagattcggtgtaataactatcccgatgctcgaacgaatccttaatttttcgcatcatttcgttaattgatataaacaagcatgacgcgttaggcttaatgttctcgttgacgcctttaagcatcgagattgctaagtgtgacttaccaacaccaggtttgcccgtaatgatggtgttagcttggtagctacgatccatgtacctgtatgcgattcgtttagcctttttcaggttcacttccgcctcactaccagcttcaacctcgtagttgtcaaagcttgcttgccacaagtcctcatcatcaataatcgaatcttttcgtaacacatcatgaaagccacgcttgtagttccgcaaagctccaatagttactaactcattatttttatgtctacgcttatcttccgcgcactttggacaaaacggttcatggttagccagcactagtagttgttgttctggatgaattcggcagtattcgtttgtctttttaacatgctttaaaagttcaaaattcaaccccgccataagattttgtccctttctctacctttggtttaatttgttggtttaaatactgatcgaacttgtttccaaacaaagtacttggctgtaagtacttatccgtaaaaaatgagttagcatcgtttgcgtctagtaccttgttatcaattaccttcttaaaatcgtccagtctataaccctcatgccatctagcacgaatcagtttcttgtttgattcgacgtttctaaagtgcttaccagctttttcatttaggtagtcgattatttgtttgtattggatatggtcggacttattgtccgacgtattattgttagtctctgtagtagtctctggtagtctatggtattggttaggactctcagtcccattcagagagggactctcaatcccactcgtagggactgccggtccctttggttttcccagattgtccaacgtttcgtaattaatcctgtaccatttagtcttatcgaaagcggctttgttatacactccagtaattagcaaaccttttctttctaaatcttttaaataacgttggatagttttttccgaaatccaaggaaactgttcatgccagttagagacactgttgtatacccaccgatagccgtctttaactttattagatttactacaccaataatgtatctgctgtagcatgattgccttatcaacgttatctaattcaaccgccaacgacggtaatacttgcagtggtggctcactgattagtaaattgttcattttgctcacccccgtagtctcctttaattttcaatcgtttcaaatcctcgatgcttaatttgataccatcaacgggcacgtgatacttagcggaaaacttagctggcgtaatgctttcaatctcactgtgatgcactctgcatagtggcagtacatgccgttttgaatggtcaaccttgtttcggttcgttcgcccgaccacgtcgacgtggtgaatgtcagcgtgttccccacaaatcagacagacccgatgtctacagcattgataaatgaaatactgctcttcgcgtggaagtagctcatagcctttcttaaacggcactcgccattcgaacatgaaatcgataactaggtctagcaactgattagcatcactaacagacgattctgtggcgtctgataagctgatagacttaccagcggtataaaactcgtactgggtatagaacattgatttcagaaattcactcggcactacgaaatacgtttcaatatcatgtagtagggcgaaaaataaccgtcgctgttgtactcgtgctctccttgggtctgccacttcaaaatcaacgtagaactcgccttgcccaccgctcactgtctctaaatggtcttggttaagtggtttgtctaaatgaataactaggtctctgcctcgttgttccgctctcgctctctgcatttacatcaccttagaaaggcagttgactatcgtcaccaatatcaattgattgtccgccattagcgaatggatctcccggcgttgatgcttgccgtgcgttattttgctggttgcctttcggtttcgaatccagcaacgagaagttttccgcaacaacttcggtaacgtacactcgttgtccttgttgattctcgtaggaacgagtttgaattcgaccctcaatgcctaccaacgaacctttttgtgtgtacttggcaaagttttctgctgccttacgccacattacacagttgatgaaatccacttcgcgttcaccctgtgagttggtaaactgtcggttaactgccacagtaaaactagctaccgcatcgcctttagccgtgtggcgaagctcaacatctttagttaggcgtcctattagtactgttcgattaatcatggagttcctcgatcctttctatttgccaatcacgaatgctattaagcacatctaattgtgcgttgtctgctgaatctagcttcccatcttttaaaagccgtctgtataacggttcgctaatattagttaatttctgatttaacgcatctagcattgcaatctgtccgttttcataacctagttcatagttttcattcatggtgcccctcctgtgttttgctgacgtggtccagttgcttagttacgagcacaatcatctggttagctgtctcgtaatttaagtcattgatatgggcaacgtgcgccttacttagatacgccgatttaactacggtctctggcttactagtggcagtcgccattgtcttgaataatgccgttagtgtttcgttttgctcgttagaaactgggtcaggttgttttttgctctcaacatttttttgaaaagaatccggatccatgtcgtcggttgcgatattgaaaaacttaagtaaaaagtacttttcaccgtaagttagtgccttaccgacacccttttccccggcggtatcaacaccctgtgcgtaccacgggcattcaattttttcatcgggattatcagtgttgacccacgtcattgtcataattaattcagtaaagcacaccaccgcgcccttcttgttcgaactcgtcattacatttttgcccgtgattcgaggaatcagcagtacaccttcttggtccattaattcgtggatctgtcccaagacgtccgatgaaccggcataggtgtactgcgttgattgttgcgatttctgcacgtactttgcgctagcatggattgtctgtagtttttggtacaacgttttaggtttaacctcttcttttggttctgctttagtcgttgccatttagtccaccgccttaaccgataacttgtctggtttttgtcttgctacataagggattagtgctccagtttccgtgtcgactaattgcccgtcctttgatgggacaaatcgcccttcagcaaccatgcgtttaatcgccgataagttaggctcttgctttactaacgcctcatcaattccagaaagtgactgcacaatttctttaggcttcgcattgtttgccttcgtaacttgccaccacgttggtttgctaggattgctctcggttcgaacatagcgccaagtagcggtctgtaattcacgtccttgaaataagttgagctcctcttgttcgacctcactaatctggtcgcgaagttcattaatttgaatattgatcccttctttatcgtgctttaacttgcgcaatttacgatctaatttgctacgcttggcttctaaatcgtcaatcttcattaggttcattcctttcaaataaagcttcggtctcattgttctcacgttctagttcccatgctctttctaggcacgggcttaactgttgattgttcatgtggtacactctccctaaggtgttttattattttcggtccgctatgccagtagcgggctttttattttgattcataatttataggttccttctttcttgtataatcgatatgaaaggaggtgaaattattatgcaactttccaatgaacagataatgaaactaattgataaacatatggatgctgcttggactgaagaatctattcaagcagaaatgaaatatgttgcttccaatatccaaaattcatctgatacccaattgaaccaagaacagatcaatgcccttgctaattctcttcaatacattaacaagatcactacgaagcaaacattaatcaccctttttaatgtatttaccgagatgggcatttttgttggttcaaatgaccagaattaatactctctgctttaagaatattcatattagcatcatttactaagtgctcctcgctaccgcaaatagcgtcgagtactttttcaatttctgctaacgtttctatcggtttatccgaaccggtcaaataaatgttcgtgccaaaacgtccatcttctattgctccaatcgattctgaatcgacgtacgtggaattatcaatttttactaacttcattactattcaccccttactcgaaaaatgagttaaatccaaatcgtccaaacatgtaggccatccctgctataattaacattgctatcaaaatcctcattgctaattccccctcataatcacttctttgttgtcatcaataaattgcttgatttcatcggcaaacatccaccatgtaccacctttgccaccgccaccaagtgctcctttatcacgaagctcttgcagttgcggatatagatgcggattctttaaaacattatctttaatccattcagtactcttattgagcatgtagtttttcaagtcgtccattttccaaatttcgtgagcttctgcctttttcttggtggtttcccattcaatgcggtctactaagactttgtcagccggtatctcgaacttaatgttcgcttcaacaatttgagccacctctgctacctccttactctcctaacgttgtttgccccgctggaaccttgctcatctctttaataatctggactgttgcggtagatggttgccaattgctgataaattcatccgctttatcaaagtccttttgacgaagctgtgaccgcgtcttaacgcctgtgacctcattaattcctcggttgatatctttgtacagtttgctacgttgtggagctgatagggccaagccatgcatatcaatgtattcatagacctttctactaattcgttttgaaatatatgcatattccgttgcatctagtcgctggttatccgttaggttttgaacagtattgcctaaacggtctactttcttattggtctcttctgtggcttcaaacatcaatctcaatacttccattggtgtttttggtaattggatacgttctgccttaatggtttcttccatctggttgaaagcttcaatgtacttcagtttgaattcgtttgccttcttaccggtgaatccaaaagcaataaaggtaaatccatcacgattcatgtaatacatcttgtttcgcttaccgctcttatctttgtattcgtcctcaacaaacatcgaattgtactgacccgaattttcgtttgagtgaattttattatcgatagcttctaaaacatggtagtgattctttccaaatacttctgctacctgtaaactggttgttactgcttgttggtctttcataattactaaatcgttcattcttatctcctccttaaaggcctagtaccctatatattttttctcgtacacgttttgactttggtgattgatcacctcggatagctcggcttactactgatggccacttctcaccaatggcagcagttaactgttcctgcgtcatccccttacgcttacgagcaacttcaatttttagctggagttctaaagcttgattttctaaagttgcttcttccgtcatttttttaccctcctttttgttttttattcatcaagttattgacttgcaattagacttagtctaatatgaaggcatactaaataagcaatacataaccttctttacaattcctcgccaaagttattgtttgtagataggcttgtttttaattgcttaattacttgatgaattaataataagtcttagtctaaaaatagtcaacctatttttgatacttagtctaatttaattcgtcaaaaattgggagaagtcttattatgacagtattagagcgtatcaaaaaaatttcaaaaaagagaggatatagtctcactcaagttaacgaaaaagctcatttaggtacaaatactatatactcttggaaaaccaaagaacctagttttaacaatttacaagctgttgctaaagttttagatgtatcagttgactacttactcggtaaaacagatatcgaaaccacaaaaaaagaaacacgtgatttggaagtcgaagaagcgcttaactccatgcgtagttaccaaggtcaaccaattactgatgaagagcgcgaagtgatgcgtggaattattaaggcatacttagataataagaaaaagtaggtttttatatggacgatttaatgacgtttttaagagattatgcttttacaaatcaaatcggataccaatttgatagtattcatgagccagatcaagcaccaaaatcaaataccgcattaagggttgttttcatgaataacaattggaatacccctgaagaaatcccctttcaatttgctcatgagattagtcatatattaaacggggattcagggtctaataatttttgtgctagttctgtatatagcaaagaagagtatcaagctaacaaacgtgccacaaaaatacttttagaatattgtgatttaaatggtctaactttttataattcaactgaatttatggacacttttggaattccatccaaagcgggatatgtggtagatgatgtatttgaggaaaaaatagatatttaattaaccttacgtccaaatactgatcgacgttaaaagctgtacatatttttaggaggagtttcataatgaaactaaagattaacgtttggactgggattttagatattattaatgccgttgtgttcgcatcatcatggtttgtgatattctcaactgctttttcagatgcagcaaacggcggtaatgctactgatggagttggcacattcttttatgtgatggctggaattggagtagttttaaatattattgcactcattcaaagtaaaagacatggtatttctattgttggttctgtacttggacttattggtaatgctttatttttattcagtggtgcattagctttccctgctatcgtgttacttatcattggaactgtatttatctttttacaacatccagctaaaaaaagtgtagattcaaatagttcaaacaatcaagctgcttaatttatacccctcccactccggtgactagatacagtccgactctgtatgtgggaactaaaaaagcatcccaaagttggaatgctaaggaggtgatattatgagcgataaagaaactagagtgctacgtccacaggatggtcgtaattttgaaaataaaagtttagctaaacctagaaccacttctgcaaaaccagcaaaccagccaagaccacctaaatcaaaaaattaacacgaatacactatcacatacgttttaactttatttttataatcaacaataattgaatctaggggatctccgttttctttgtatgcatttcttgcttcgtccatggagaattcatcttcaccatcgccatataattcgacttgttgattaccttgatcatcaacatttctcacaaatcctgaagaaatatatttaccatcaaaaccaaaagaaattaggaattgtttttttccttttggattttcagctaatgagtgttccatcgtcccttgattatcataaagatttacattgagtaaatcagctaattttcgtgaatacttgttatatgcaacaaataaaatgaagtagatgccagtaataattatcgcactaacaaagattgcaaaaatactatttttccacaaataactactgagtgtcgctgaaagtcctgaattaattagcgacaaaataatcaaagttatctgtctatcagaatcattttgaaagttaaataatccaaacggtcttaatactatatatgaaataaatcccggtactaaataaattaaattatccattcttgacccctctctaagcatttgtatagtacaagtatataccgaatgagggttcaaaaaaagccacatcccccactcgccaagtaagatgttagaacgtgattggccgatcattgcagctaacatccctggtattttcttaggattttttacattctataccgcgttacattaatactttatttacaaaggagcgaatagtttatggaaacgagtattatggctatcattggaataattatattttttattggagcattaataataactcttggtcgaactttaaatatcttacgtttcttttttggtgatcgtagtatgtttacgcagatgttttggggaattatctttatctgcattggcttatttttaatcatacttggtagccctcagcttagatgatatcctctttccactccggtgactagatacagtccgactctgtatgtgggaatagaccaataatctgaatgtcgttaaaagctgtacttatcatggaggaaaacgtatgaagaaatcatccattttaaccatatagcaaataaataatcttttaaaaattaaataatttatttatcaagcactatatgtggtactacgatttcctagtactaggttttgacgtcgcatatataactatatatagtgttagttcacccaaggatatcgtttgacaaatagtttttgcgaacatataatacatttaatcaaaggaatggtcgcttgcgacccactgggtgagtacatttatatgtgcttgcccttttattttgcccaaggagagctttctatgtcacatgtagataaaccatttatgcaaacccaagatcaattaaatattttaaaagaaagaaatttaaacattattactgaagaatccgcaaagaattctcttcgtaattatggatattacgaaataattaacggttacaaacaaagatttatgattgatccaaatgatgacaaggcgggttttaaaccaggtagtaattttgaacatatttttgcactttatacactagataatgaaatcataaatgctatacgcgattctttagaagcgtttgagcaaacatttaaacaggccctcgcgtatgttatagctcgtgatatctctgaagatcaacgtagatatactgcaaagacacattataacgccgggaaaagccatcgatatcgcaaacacgggcatatggttgttagcactgaaagagactacctattaaggaaattcaattctattttaaactcaaattttgaaccttttaaatattaccgagaaaatcatgacaacataccaccttggatattagtcaaaggcttaacttttggaaaagctatatattggtattctttatcgcaaaagtctatcagagagggagttattggcaggttaattgacttagatccttctattgtgcgagctgttgacgataatttacaaatcaagtgcgcaattggtgacgttttgaatttatttttagattatcgtaatctttcatcccacgttggacgagtatataatcaccgttcagaacggcatcaaattcggaattactctagttttatatatcaaaacaacgttattgctcccatatctaaaagtgcatttagtaaggggtatctaagaagtagcattggaatagttttaagggctttaaacatgtttaagaataaggatccttttgttaaattagaagcctcactttacttttacatttcaaagtacttaaaaaattatcctgaggatagtgattttttattagacgttatggaacttagagatacttacgtagaaagaagacttttgactaattaaaaaagccacatcccccaccgaccaaagtttgggatgtgactatcacttagaaaaaccacggaagtggctcctttaatgtacgcttattttaacattgaagcctgcttccaacaacagaacggaggttcgcttttatggcaagtattaaaaaacaaaatggaaaatggactgctaggataacctggcgagatgaggagggaaaacgtcactacaagagcaagtataattttaaaacgcaatctgaggcagaattatgggccgcagatttccagttaaataaacgggatattgatagcgaaacttattttcctgcttatttttatgattggtacctaacgtataaagaaccctcagtaactaatcggactaaagctacttacctacagctatataacgttttaaagaagccgttgcttgctaaaaaaccggttggcgagatcacccggaaagattaccagcgtttcatcaacgtctttggcaaaaaacatgctaagtcaaccgtaacgaaatttaattcgttaattcatgcttgtgtcaaagatgcgctctacgataaggccattgaaaaagattttgtctacggcgtttccatggtcttcaacaagagcaaaactcgcaaaattgattatttaaacattgatgagatgaacaccctatccacttatcttcgtagtagtttaaataagcattttacgagcaagtacatgattctaactgcgatttatactggcgctcgtctaggtgaaattcaagccttgacctggaaagatatcaataccacctttaataccatctctattcgacggtcttggaatgacgaagaacagaaattccagccaactaaaaacgaatcgtcagtgcgaatcattaagattaacgacgatttagcacagttattgaaacagctgaaacctaagagcagtagcaccaagatattcactaatcaatatggtacggtgccctcttccagcgcagtaaataaaacactccgggaatcattagcccattgtggaatcgataaacctagtttccactttcattcgttacgtcatacgcatgtggcgtatcttttatccgaaaacgttgatttatttatcatatcaaagcgattaggccattctgatatatcaacaaccagtcgagtatattcatatctaattgacgaatacaaacaaaaagctgatctacgtattgaaagatcacttgataagatttcactgaattcaaaaaatgagcgaaaaattttatagcaccggagtagcaccgaggtgcatttttcatataatattctcattttattctatctaacaaaaaagtggcttaacaccagtgtttccaaggtgtcagccactttttcgacgtttcataaaaccttctaaaagggtactaataaggagagtacaggatttgaacctgcgcgccggtattaaccggttcgccggatttcgagtccggtgcattaccactctgccaactctccataacagaatttattatatcagatgaattattaacccgcaacaccaatcaagtatttttttaaattttatcatgaactttacccatgaatattaacacccttttaattattttaaaatcgcttaattcttgttaattaaactctttagcggtttcatcaaatcaatacaatcgcacctccttcttcaagtaagattagctgacctttatgcctatataaagtttatttagtactatttttaaaacattttaccgaataacgtaaatatagcactcctaaaatatccgttatcgaaaacatttctcgttgataaagcatttatcgtgtataattatatataacagtaagtattaaggaggagctaaccatagattctaccaaattaatgaacaagcgcgatttgcttgcgtatcaattactccaattttttagtcagaataacgtaaaaccaattagtacctcctcgttagctgaaatcttcaacacgactccgtacaaaattgaggcttccatcgctactctgaacgctgatttacaaacaattactgctaatgaccacagtgtttacgtaagtgaaaaatcatataagggaatttggagcggacataacctttttcaaatcattgtcgacaaagtcaaattatattatattgaacggtcgactgcttttcgtgccatggaatatttattgttttataacgacttggttacccccaaaaaatatattcccagggctttctcaagccgcgccgttttttatcgtcaactaactttagttaaacaattactaactgatgagtttaacaacttaacaatccaaactgataaagaccgggaatttcagattcgattagaaattattgaattatacgaacaaatttataagggattaaaagagccctttcccgaactagatccattaataaacgggatttttgatagcttaacgcccttttttaaacatcaattacaacatggtgaaaaatttaaattatcaatatttctacggatttggatattacgccataataaccacaagtatgttcgtttttcagcacctcatccgcttgatgataaacgctatgataaaatttatcacgtcttaaagcagaccctaggctggcactttaagctaacccattcggaaatgctttttttgtacggttttttattaaatcaagattacttggattatgcggggatcccagaggatacgtgcaactatcaattaattaataaaattacggatgattttctaaattggatcaaatcgtttaacattttagcggactttccgttggaagttgaacaatctttaagaaaagacattactaacgtcaatttaaaattattttcgtactacgcggaactactagacgcaacttacaaaaattcaatccataccttacgagaaaactatcctacgtttgatattttaattcagcaattttggcaaaaacttgttgctcaacccgagcttaaaaaataccatcttaataagtacaacttgtactatggttacatgttggcattagctaataacattcccgctaaatacagtcgcgaccgtgttagagtggtgattgatttttcaaagggtagcctgtattcccagtacgttgataatacgctaaaatccttatatggaaataacgtaattttgactaatcatttagaaccacaatccgatctcttcttatcagatacgtattcttacaaaattaaaattccacagctgatttggaaatcatttccaacagttgcagattggaccaacttaattaccctaatcaaggaaacccgatcagcaaaagctcggcaattttttaaataacaaattaaaagcgtgtaagacaaaaatcggctagtttgcgagaattaactgaaaagcgaccgttatgaattggcataacggtcgctttttgattaagcaaaactaactgatttttagcacatattttgcctctattggagccaaaataccaaaatagctttttgagaatccttgaaaaatatttctttaactttgttcaagccccctccagctcatcagttaaaaacatccttaatcgatattcaaaattttacgtaccttgttaggcaccttgtccttgctgatctcgttaggtccctttattacccgttttttcgaaatctcagccttaatgaccgcgttaggagtaaatggcttaaccttttctcccgatagttcgtaatctagcgtgcgcttttcaccattttttaaaacgaacttaaatttataatcgtaagcgtgttcgccagtaattgcttttccatcgtcatcagtagcttgttttttaacgggaacttcggcaggaaccaccgcgtacgccgtttttgcttggtaggtgtcttcgtaatacttccatccaaaaataatcactactgctgcaactagaattgctaaaattcgtcccgcatctctcattttgcattctcctatctaataagtcattaccaacatctaatgtttgtaatgaggataccatttctcggtttgccattacaaaaataatggcttctgacatccagaatgattgtcggattaatcaaaaacttactggccaaatttaaaattgtgaatgtagtcttttcgaacacaaaaaaggacgatcttacagatcgttcttccttaaatattaataactaaaaattgctaattcttacggctttgaataaaccatgatacaacagctactaagattaccgctccgataatcgaaggaattagtgccattccagctaaggatggtccccatgttcctaataagctttggcctaaccaagcaccaattaaaccagcaacgatgttacctaaccaacctgctggtaaatcacgactagtaagcgcacctgcaattgcaccaataatagctcctacaattaatgtccaaataattcccattattacgccccccttcattgcgctaataataacaaatgttcattttatacacaaacaatatgcactaataacgtattttgtaaaaaatctgctgagttctcctaaagtttcatgcttatttttctgggagtttgttacttcaaacggtcttaatagtaaaatctttccagtgctgtataattttattaggaaagaaaggaagttattatgaataaatcaagagttgaagcctttactgatgctgtattggcaataattttgacaattatggttttagaacttaaagttcccgattctagtcaattaagtgcgattttaagcgagttgccataccttttttcatacacggttggctacctcctgattggagtggcctggtatagtcatcattacatgtttagcaagactgccggcatttccaaaagagtttattgggcaaacaatttttggatgttcacgacttctttcatccccatggcaactgcctggattggacaagatttgaaagcacagggaccggaaattttttacgccattatcttttctatatggaccgcggcttacttggttctaagctacgtaatttcaaatgacgacataaaaagaaaacagtataaaaaagcccatgacataagaaaaatgaagatatatcggtatttgacaaacataaaatatatgacaatccaaaccactgtcctggttatcatcttagtttttaagcctgaatttttactagtggtagttttatggcaaatattggcattcgccatctggaataatgatgatagtgacaaattattttaaagaatgtcatgcctaccttcaaagcaaaacctagcattttcatggatgaaaacttacattgctccttttttaattaacccataaaaaagaaactgcaaaagctaaatctgctggtgttttgcccttaataaagtcaaaacgtgcgccaaaagtcagttggttctgtttaacaaaaaaacgatcgttacgccaaattcaggcataacggtcgtttttcagttaatcctcacaaactaaccgacttttgtcgcactctcgttttcattttaacctactttatctaaagtagctgtttattagtattttattgtagttttctaggctgcagaacgttttgcgttgatatagttaacgataaacgtcaagcccatcaagaccactgggtaaaccatgtaacgaatcaagtctaagtagttcgtactcttccccgcaagttgaagggtcatcatcatcgcggaatcttgaggaatgaccatcgaagccgtaaccgcaaaaatggaaatcactccggcgagcaccttcttatcaacttggtattggtcacctaattccttagcaatcggtgaagtaatcaaaaccgaaatattgttattaacgattgccccggtaacacagaaactcaaaattccaatgagggcttcacaacttgccttgctcttgatatgccgggtgaacacgtggaccatccaatcaattccgccatagtgccgcattaatgcaaccattccgttaaccatcatcgcaaagattgctagccagaacatgctttccattccgttaccaatcgcctttgcgcacgcaaatagggaagctttacccaacgccattccaattgcactggccattacggtacctaaagctagtactagtactacgtccattcccatgacagccaaaattaaaactactaagtaaggcaaaatggtaattatgttataactgccagcatgaatattgctagcactgctattatttaaactcattaaagtataaataataatcgtgattaccgctgctggaacggcgatcttaatttgccataaaaacttatcacgcattcttgcgcccactcccgctgccgctgaaatggtagttccaccgatcattgagagtccgtctccaaagtacgaaccggtgattaccgctgccccagccattcctgcgtttaagtgtgcagctgctactagcgaaaaggtcactggcgccatggttacgatcgtccccgtagaagttccgatacacagtgaaatgattgccgcaatcaagaagattcctggtaccagaaattggcttggaatcaacgaagttcctaaattaacgattgaagactgtcctcccgaaattgctacggctgaagaaaagccccccgccatcattacaatcaaagaaaggttcattactcctgcatttccggcgttgtttaggtagatgttcattttcttggcaaactttgcccgcggttcgaagaaaattaaagcaaacaacaacgctactaaaattgctacctgtcgtggcatgtacgaagacggatccttggcacctttaatcgtaaagaccgctaagcagcctacgtacagcaccaaaaaaatcagtaatggtaacaaaccagccgcgccataatctttgcgcgttttcttttccattctcaaatccccttaaacatttattggtctagcacttatctataataccaaaatcccgttcaattaacataactactaaactaaagttagaggttaccattaataagtaaatttttcaaataaaaaccctctgtaacaggtagttccgagaaaggcgctcttttctcctgaatcgtcacgtaattttttcaataaaaagaggctgagaaaaaataaagtaatcctttttaaggatggattttttggaaaatcaggctggaatgttgcctttactatcatagaagcaaaagtcaatttttcggttcaatccaaaaacgaccattaaaccaaattcaggcttaatggtcagttttcagtaaatgttcctaaactacccaacttttgtcttcctctttacttaattggctagtctttttgggcatttagatactgcgtaaatactgtaatatacatcttaataaagtttaaatataagtccttttcaacgtattcatcaacttggtgaaccccgtcaccggtcggcccccaaatcgcaaatggaaaaccttcatccttatcccttagcaaattagaagcatcggtgaccgccggaatcacccctggtttaattggcgcaccacgaaattcgctaccgacttgttgaattaattccatcagccggctttttccagttgtttccaccgcatcctgagtcatgtaggcttccaatttaacttgcgcgcccgcgtcgttttgctgatcgactaatttttgaaggtcagcaatcacctgttgattggtaaaatttggaatcgttcgcacgttaatttcagcttcggccattgccggaatcgaattaacctggttcccacccttaaaaattgtagtatggaaggttaacggcccaagtaattcattttcaactgcggaatcacggaaatggtgattagccgcgtgcaaaatttcaattaacggatcaatggcgtttttaccgtcttcgggcatcgaactgtgtgcggactgccccttagaagttaacctaatatctaaggaacccttatgtgaaaatgccggatcatagccactcggttcgccaatcactaaagcatccacgtcgtccatcagtcccatttcagcaattttttgcgatccttcttcgcccacttcttcaccaaaggtggccattagccgaatggtgcccttcttcagcaggcggttgtgcttaatttcaatcaaagcgattaccatagctgctaagccagatttcatatcagccgcgccacgtccatacaaacggccatcacgttccgttagttcaaacggattactggtccattcagttgggtcacctgcatcaaccacgtccatgtgtcccgaaattcctagaaccgggctgcctgaaccaatttccgctaacaaatctgcccgagtgtcactatagcgaagaactttagcgtcaatcccattttcctttaataatttttgtaagtactttgccaccgtaatttcgtgatcgttagtagaattaatcgcaattaaatcccctaaaatcgctatacaatcctcatttgtaaataccggtcgttttaattcaatgtccattttattcctccttgcgtgcacatcttagtgaaaacgtcttcatcattaattgaatgcattttatcactaatactcgttaatttacaagaaagaccctctaaaggattaatttctggaatgtggtgcgttaagttgctgaattagtttttgattttggtaattacgataataatagaacgtgaggatatgcagtattaaagtaagtatcaagatttcccaccagaaaggcaaaaccattttaagaattttactagaaaaaagccctagtccaccaagaagtgcgccaaaatttattaatgttgtgcagccaatatttctaagcgccccccatgttgtgtagttccatatgtacggatagataacgccaaatacactcccgccaataatggcgattaataagagatgccataggtaactaggtgtcatttccaaatgcgggcaaaatagttcaattactactatcaaccaccccatgaacagaaagctcgtctgaaaaaaggtatgttttagttgagttatcaaattaacccctccttcacttttttagcataatgccggctaacgatgaaactttccgcatttttagtatgtacttctatacgtgcatacgtcgctttcttaaattcggtaacctggtccatattcagtatcgttgaattattaatccgcattaaatttttcaacgccaatttttctaaatctttcaaccttcccctgatatagtagacttggttatttaccgtataaagtttcgaaagatgatccatcgcttcaattagataaatctgagaaatatcaatcttaagccttcgttcatttttgggattaattacttccacctgatctttgaagttaaaacttcttgttattttgctagcgtactttttattatcggggtgtagagtaatggtagctttgtcaattgcttgttttaaatcccatttaaactcaaggtaaatcattaaaagcctcccttcattgaccaaggttaccgtcttttaggggaatccacaatatttctaatttttgttgcaaaaacgcttcctaagttgccaccttgccttactagtacggtttaagacagagcactcgaaaaagaagctttaccacatggtgattaaagccccttcaatctttgttatttatatttttaaatttgagcgtcggttttgctttatcgttctgcttcaccaacaattttattgatgtccatgcctaaagccctcgcaactcgggtgccgtaatcatgatcagcgtcataaaattgactaatttccagccgtttaatttcgtcagatttaacctggcctaaagctcccttaattgtgtcgattaaccgatctttttcaactgcggacattaggcgataaaggtcgcctgcttgagtcgtataatcaacctggtattcataaggttgtgccatcgcttccccgtccaccttgaaaggtttaatggaagcatcccgctcttcagtaggtccgtcaaaggagttgggttcataatttacttccggcccctgcgtggccttcatagcgccatcacgttcataattgtgtaccgggactaccggacgattaatcggcaagtcttcaaaatttgctcccaaacgatatctttgcgtatctttatatgaaaatagccgaccttgcaataatttatctggcgaagcttcaattccaggaactaagttagcaggtgacattgccgcttcttccacgtccgtgaagttattagttggattttcatttagcaccatctttccaaccttaatcaatgggtaatctttatgagaaatcaccttggttacgtcaaagatgtcccacttatagtgcaggcctgcttcgtacggcaaaatctgaacgcagagcgtccacgatgggttctccccttgagcaatggcgtcatataaatcatcttgtagatagtcagtgtctttaaccgtggcttcggctgcagcttcattcgtcatgtttttaacgccttgatctgaaatgaagtggtacttgacccagaaggcttcgcccttttggttaacccatttaaaagtatgggagccataaccattcatcgttcgataagatgctgggagcccccggtcacccattaaataagtaacttgatgcaacgattctggggaatgggcccaaaagtcccactgcatgtcctgagtacgtcggttagtttggggatcccgcttttgagaatggatgaaatcaggaaacttgagcggatcgtttacgaagaataccggagtattatttccaacaatgtcgtaattaccttcctgagtataaaatttcaccgcaaatccgcgcacatcgcgaaccgtgtctgggtagcccttttctccagccacttgggaaaagcgcacaatcaagggggtttgtttgccaattccgttgaaaaggtccgccttagtatacggactcatgtcattttctagcttgaaataccccttcgcaccagcacctttggcgtgcacaactcgttcgggaatccgttcccgatcgaaatgggccaacttctccagcaaattgtagtcttgcatcaataccggaccgcgacttccagcagtctgcgtatgctggttattgacccacggttgtccagcctccgttgttaatttttctgacatctctattcgacccttctctaaaaattttagtagatctactattcaataaaactaataacgttatttgccacgaattataacacccgccctgctgataaagaagcaatatgccttccgttctcacctttgacccgcaatggatatgcattatcaaactgcttgtatacctatcgttacagtaatttattccgcaattgcttcaactcgtcgaaccgcatattggttacgtaatggtttaaccattatcaaaattaaacatcccacaattagaattccaataagtaccagaggtcgccataaatcagtccaactaaccggatgaattaaccaatttgtcgggttcaaaaggttggtgggcgaccatttcataaatccttcaagctggctaaacaaactgctaattaaaacgccaatttcaattactcccgcagctaaaaatggtgcgccagaatatatggcaatcgtacttgccaaaataacactcgttacaatgcctaacgcttgtaacagtaaacttggccatactaagtcgaaacgaatggtgctgctaaagaaagcccaatccacataaactgcccaaccagcccccattaccgtgcctaaaaccacacaaattaatcctgccgccatttttggaaaataaattggcccagcctttttggcacgcgttaaataaaaaagttgttgtgcgggattttttcctaaagtacaggcatccgcaaccaaatatgccatgataaaaagtactacttgctccgtactttggaagtaagaagtcattaaactatcccaagtcggagatggaagctgaatactggcagcactgccgccaccaaatttttctaccagttgatcactataatatgccgataatggtgctacaatccccatcaatgcagcaatgagtaatattaaaaacatccgctgttttcgaatccactgtcgtaattctaatttcatttagctttctccttatcttttgcgtgaatccaccgctcaaaagcatggttaaggtcctgactacttcgattaatcattaccacatcatcagctaacctacttaattcgcctagccctttttcaaaatcttgtgctggaaactcaatttgatgtcgttgaatctcctttaccacaatttgacattgctgtaaggcagccactacccgatccttagcgttaaccgatttaactaatatttcaaccgaatcatccgttcctgcgataaaatctgtcaacgctcctgaaaaaatcatttctccacgattaagtacgagcaatcgttcggcaatttgctggatatcattaagtagatggctcgaaattaccaccgtcgtagtttgtgctatttcattaattagacccaacattgcctgtcgaccgaacgggtccagtgcactggtaggttcatctaaaaatagcagttggggttttaagatgttggcagcggcgattcctaatcgttgcttcattcctcgagaaaatccacctactaaccggttttggtgttccgctaagccaacttgttgcaacgcagttaaaatgtgtttttcatttatgcgttgattatccaagcgaagtgactgttgtaaaatttcacgagcagttaaatatttttcaaactcgggagtatctgggcaatatgccaattttgccgtctggtcgattaagatttgtccatgctctactggttcttgaccaaaaatagcgtggatgagggttgtttttcctgctccatttggcccaatcagacccaccactcccggtcggttagtaattttaccgttcaccttttttaaagctgcgaaatccttgaaacggaccgttaaatcatgaatttctactaaattacccattctaccaactcccttcccgtcgctctaatagataatatgcgatcccgcctaccggaattgctaacaatgtcaccactatccaaccccatttaggtaagtaatgcgttcgtgaaatccgacaaatatcattaattatccaaaacagataaatcccaccaactaaaattagcggaacaacaatctttaaataagccattattggttctccttttcctaaaactaattgcctacctcctttataaatgatgacgttgggtcgttagcaaacatttttactcaaaaaatactattcaactgttttttctccaaaaaagacgttaagtcgttcttaaaccaaaccaaaaagtgcgccaaaaggcagctcgtttttgggtattaactaaaaagaccactatgcctgaatttggcataatggtcttttcggtttaaacggcgtgactagttattcatttttaactctacgtgtaagggaccagaaaatatcattaataggcgaagcactaattatttttgattcgtaatcaaattagatgcgtaaataaattactcttcgccatcacgcttccgttttctaccccatccgaagaatccaagcaaaattgtcagcaaactaagtaccccaacttcactcataatattagactctacttcgttagtttgtggtaaccgaccacgtttcacaagcgtcgtccgttccttagccgatatctggttatcctcattggttctcaccgcgctgactggttcacctggaaattgatcactcttattatattcattcgaagtgtctggagtagctgctgtcccgtcaacttctccgctgttatccgcgggaagcactggatcttccgagccctggttttcattatgatcaccatttggaatttctggctgatttggcactgaatttccattatcaccgtttggaacttctgggttagctggaacctggttattattgtcatcatctggcgtttccggatcgactggaacttggctatcgttgttattatcatccggagtttctggatgatctggtgtcggattatcatgatcatcgtctggtggtgtcacttgatgatcgtcgtcggttacgtgataaataacgttgacaacaaaatcatttccaacactattcgcatccatcgctggaacttctggctgatctggttcgtagccattaaccactggcgaatccactgccggataatcaccatccgccttccacggatcgtaagttacttctgccgagccatcttggttaaagtgcacgtggcccttccgagtgtaatgcaccgtgaccgtcttatctggggcaacttgcttaccgttcttatccacgtaatgaatcgtttcggtgacgtccttgttcaagtcgtttacgtctaccccagctgggtaatctggactgttaggatcatctggatcaaccggcgtatctggagataccggatccgatgggtcgacatcaatatcggaaccatggtaaattactgtgacttcaaaatcagcattcacactgtctccgtcaacttctttaaccgttggcgtatctggaaccatgccatcaactactggtgaatctactgctgggtagtcactgtcagctttccacggatcgtaagttacttctgccgtgccatcttggttaaagtgcacgtggcccttccgggtgtaatgcaccgtaaccgtcttatcaggtgctacctgtttgccgtctttatccacgtaatgaatcgtttcggtgacgtccttgtttaagtcatccacatccacaccgcttggataacttggactgtctgggtcagatggatccactggtgtatctggtgcaatcggatggtctgggtcgacatcaatatcggaaccatggtaaattactgtgacttcaaaatcagcactcacactgtctccgtcaacttctttaaccgttggcgtatccggtaccatcccatcaactactggtgaatctactgaaggataattgccatcggctacccacggatcgtaggtgacttctgccgtaccatcctggttaaagtggacatgtgctttccgggtgtaatgcactgtgaccttctgatcgggtgctacttggttaccaaccttatccacgtagtgaatcgtttccgtaagatctttattcaaatcatttacgtctaccccagctgggtaatctggactatctggattagacggatcgaccggtgtatcgggtgcaatcggattgtctgggtcgacatccacgtcagatggatagtaagttactttcacttcaaagtcgtcatctttactattgccatcaacttccgcaaccgtttgcttatcggggaacataccgtcaattactggcgaatctaccgctggataatcctcgtcagcttcccatggatcgtagctaatcgttgccgtaccatcctgtttaaagtgcacatgacctttccgcgtgtaatgcaccgtaatcgtccgatctggagctacttgtttgccatccttgtctacgtaatggatagtctccgtaagatccttatttaaatcattaacgtccatgccagcaggatattctggactatctggatttaccggatcaaccggtgtgcctggcacaattggatattctggatcgacatctacgtcacttggataataaaccaccgtcaaggtaatgtcttgattcggtttccctggtttagcaacggtttgtgcttcaatatgcgcgtgatcagccacgtaaccatcaactatgggggtgtcgaatcccgcaaatttattgctggtgtctggttgccattcgcctcgtgaaattacagagttgttcacttcatcaattaccacttcacggtggtacgtcaacatcgcactggtatccgggtaaacagttttcccttgattgtctacgtaatgcaccgtttcattaaccgtccaagtagtttccttgctccattcgggatcatccggatcaaccttccgatgtttatgtctcaaataaaccgtaaagtcattagcaccatctttagccgaccaagtaaaatgaaccgtttgcccatcaacatatccattcggattattttccggatcaatttcataatgtgctggcacattgattacaaaattgccgtcttcgtcagtagaaccatttaggctgcctgtactaactttcttattatcttcatcatcccaataggtgaccgaacccgttaaagcattaggtgagtacgtcaccgtcacttcaattccgcccttttctctgagttcgtcgtcgatgattgttttatcaaccaccctaatatcgggtgtataaccagaaatttttggagaatatactgggtcaaaataagtattttcgccatcagcaattttccacggttcccaataaatttcaccagtatccggattttgatgccctttccgactgtaacgccgagtctcggtatggtctggaagcatctggccgccatttttgtttacgtaatggatggtctgggtaacgtcttggtcttcattgattgttttaaatggcctaattacgtacgtatctgccatgcttggattataaagatccatcaattcgtgtgatgtatattgttgcttacctagaggattatcttctgttcccccggcgaccgcgacccaccggttaaaagtatatataaaagagggctcacttaaatgtgcaccggcaattttagttttcttgcctaaaaccagtactctcaagttagacatagcggtaagcattctatcgtatctagtaacattagacatatcaatatgtgaaagatctaatcttgaaactccacaagcttcaaacatataattcatgttagttacgttggacgtgttccaatgcgataaatccaagttttttaaatttgcgcaactatcaaacatactttctaaagtagtagcacttgatacatcccaatgggaaacgtcaagctacgtgagatcgttacaaaaatcaaacatccgtttcatgctagccatattagacgtattccatttagaaacatcaatttttttaaacgaatacatccttcaaacattgattccgctttgtttacattagccgtattccagccggaaacgtcgccaatgctttctaatgaactatcctttgagaacatatagctaaaattgttagcgttcgatacatcaaaattttcaattttgtatacattttttagcttagttaaaccgccaaataaatgaccaacttctttgttagccttaactttaccatcaaatgaaatgttagtgatgttgtccttatagtcaagccacatcgaccgattattggttaaatcaaattcgccctcgccaaaatgtagcataccatccgcatcgatataccaagcgcttgtaccaaaggttccgctagcgacgttgctgctaacatttttaggttctttcttcacatccctttttggcgattgtcgattatcaccaggcgtcttggtttttgtgactgaattaacttgtttttcatccttgcttaaagtgttttctgaactggtcactttattattcgaactagaatccggagtagttacatgccccgtcgaattggacttgttaaccgtgttatcggctgtggtgggagtgtctgcctgcttttttgagctatccgatacttttgaatttggaatggctttcgaatccgtttttgtttctgatgttgcatctgaattgaccgcttttgtatccgctttcgaatcgctgtctaagtttgtttgcgcatcagcctcagtctgcttaaccgattttgtcgttacatcactgctagtcacccgcgaaggttgggttcccgtttgattttcggttacttgacttttagtagttactgccttctccggactttgtactgcatcacttggtcgagatttgacttccttggtaacggccggtgtcagagcggatgattgagccgttgtgtctgcagatgcacttggtgccgtaacattcaaaccagccactaatcccacaatagctaatccgctaaaaacccagaatttgccatctttatacattttataatgttgcttgacttcgtacttcattagcttaatcctccaaaaaatttccgctgttacttaatctccactctctagttgtagctattttttataagtcagataagtacacgcatacttctaaccacgaatttatattttaaattgaaaatttaaaccccattacttattgagaaaatgtatttttaaggtagaccctaaaaatacattatttattgtatatgccctaataattttaccatattttaagtaacgagtataaattaatttcacggtgaaaacaagctcagaagtactggttttagtgcttttttatgtaaaagcatcgcgttctgcaaaaatatttttttcacgtaacagtacctatatccttaataatttccttaaaaattgatgtttttttagggtctactttaaaaaaacactatttcggataaaaactattttggcctctttattcaagccctataccatcgcattacttagctgatcgatctttacttattgcattttgcttaccgtcttagcatctgatattttttaaacacaacaaagcgcctacggatttttctccgtaggcgctttgttttaacatttattaaagcaaattcaatactcttgtaagctaagtttatttattctaagttctttagtactccattaaactaagcatgtcgtaatcacgaatcttttcgcgtccatgcaagtctttaagttcaattaagaaggcagtgccgactactaccccgccaagctgttcaactagcttgatggttgcggcaatagttccgccggtggctagtaaatcatcggtaattaaaacccgttgccctggtttgatggcagatttttccaaatataacgacgactttccgtattcaagtccgtaggaagctttaaccgtttcagttggcaatttacccttcttccgtgcgggagcaaagcccacccccaaggcgtacgcgactgggcagccaacaataaaaccgcgtgcttcgggtcctacaaccatttcaacctttttttctttagcaaagtcaatgatttgattagtagcttctcggaaagcttctccgtttcccattaaaggtgaaatatcccgaaaaataactcccttttctggaaaatccggaatacttgcgatgtaatcatgtaaatccaatgccatttaagacactccctcattctcaacgtttagtaactgggttagcatggttgccaattgatcaccgttactataaagtagtttttcctgcgtttgaattaaatccaaacgcttttggtagattggagcttcagataattggtgagtttgaacttcgtcatttatcaaaagctttccttgttccattttaacaaaatttagttcaaagaatacttttaccataaaattaaccttttcttggttaatttttaattgttttcctagctgtaacaatgccgctttagttaatggttgccgtttgaccgccgcaaaaactgtcgcaaattcagtacgacttggcatcccacttgcgtagtaatcagtttggtggaaaaagtaagttgtaatttgagttggttgccacttttgcaaagcctgtcgtagaacttttaaactaggcggacaatcaaccagtactacggcttgatgggcctgaattgccggggaatcgtaaagataaagctgacggcccaagttttgtttttcaattaaacttaatagtttgggattgaaaaagatgtactgttgctcatcacggaacagattcttggctaaattagtggttcgctgatcaaccacttgcaatccgttaattttcaaatcctcggtcattaattgtagtgttacattcccccgccactcgttaatgctcaacgttccggccaggtcaatggtgttggataagtgacttaatttatccgcgatctccccgcgttggaatgcaatggctgctaattgttggccagcttgatttgccgtgaattttaagtgagcttggttttgaccaattgccttcacatcggtaacccgtacgttggtaattgccaatttaggcaccggattatccattccaaacggacctaattgcttaattttgggtactaagtccgtggaaagctcgctaattgcaaccgtagcatctaaattcaactgcggccgttgccgaaaatcgagttgggcttgttccgcagccttttcaagttggtccgctaaaactggcaaattagcctctttaacggtgatcccaattgccatgtgatgaccgccaaaaccttcaaaatgctcacgcgccggattcaaggcttcaaaaaggtttaaattggccacgctacgcccggaacctttatatacgccatcttggttttgatcgcttaacacgatggttggtttgttagtcagttcgactaagcggctcgcaacaatccccagcactccctgatgccaatcgtggccgctaattactaaggtctgtaaatcgcgatggtcttcatctttagcaatttctgccgccacctcataaatctcgttaactaacccttggcgtttagtattggtggcgttaatgtccttagcaatcgcggtagcttgttcctcgtcaaaggtcgtcaataattctacggcttggctagcgtctcccaagcgaccaacggcattaattcggggtgccacggtaaagccgattgtttcttcatcaatctggctagtttcaacgcccgccaccgcgattaatttttgcaacccgattcgggaagtttctgggattagctgcaatcctagcttaactaagaggcgattctcgtcggtcatcgaaactaagtccgcaattgtaccgattgcgtataagtccaaaaactcttcgggcacttcttctaatagcgcacaagccaccttaaacgcaactcccacgccagataaatctccgaagggatattctccttctggatgtcggggatggacaattgcgtatgcgttaggcaattgatcgggcatttcgtggtgatcagttaccaccacgtccacaccgtgctcttgcgcgtaattaatggcttcgttgcccgcaaccccgttatcaaccgtcacaattagttgaacctgctcatcgttaataaaatgctggtactccgctaagtttggaccgtatccatccttaaaacggttcggtacaaaataatttacgtccgcacctaactgagcaagggtttcatacatgatggtcgtactcgtcaccccgtcagcatcgtagtctccatagaccaaaatcttttcgttggcttcaattgcggacatgatccgttcgacagctttttgcatgtcgtgcagtaaaaacgggtcgtgtaccacactttgatccattgccaaaaaattggtcatttcgtcggcagtccggaaaccccgggcaactaggattcttacaatgattggatccagctgggttgctttagctaactccgcaatatccacatccggcagtgaaggtacctgccaattaaatcgactatctttcattaagtaacatactccagttatttccggttaatgattggactgttaaccagtccgtcacctaaacgcggaaagatttgataaaatactgctcctaaagccattaccttaggaacgtttacttcgcgcagattttgttcaattgctctacgagttagccacgcaacccggtcagaactaatgacgaagttttgcacgcctttaagatacttaccgcttggatcagcaatgttaaaaaagttcgtatccattggacccggattaatcgtgtgcacccgcacgttccgccgttttaattccaagcgtaacgcgttcgaaaagcccactagtccaaacttcgccgcagcataagtggtggtcttagcggtagcaacttttccagcaatcgaggcaacgttaacgatgtctgccgcctcaccgacgtggtcaaccatcagcggtagcaacgcccgcgttagcttaatggttcccgctaaatcagtgctcaacgttcggtcaatttcggaaaaatcttgattcaacaacgttttaaaataacctaatccagcattattaaccaacaggtccacagagcctaaatggctacgaatccaacgccccgttgcttcgatttgcgcttcttgggttaaatcacaagataacgtaaatacttgccgggcgccacatttgaaacagtcctgcgcggtttgcttcaacctatctgaatttcgccctaaaaagaccaagttatcgtaataagggcagttcaaaatcgcaatttgccggcccaaaccacttccagcacccgtaattaccgcagttttcatcaaagatcatcctcctttatttttcctaacttcctaccaaatcggccacctcaggcccttacggaagtggaacgtcaatttcatcaaaatcttgaaccactttagtattggcaaaaattgtacaagcatctttttctagctgtttagcgagtttaccagtgtaacgagctgaaatgtgcgttaacaatagtttttttacccgacacttttgagaaattcgggcggcttgcatattggtcgaatggtaatatttccttgccaaactaccctcctgcttgccaaacgtactttcgtgcaccaaaacgtcggcgtgataagctaatttttcaatattggccgtctgacgcgtatcaccaagaatggtgactacccgaccaggttgcggcttgccgatgaaatctttgccatcaattacttttccgtccggtaaagtaacctgtttaccctgcttaatttccccgtaaatcggtccagcaggaattgccatttcctttagcttatccaccaatagttctccgggatggtccttttcgcgaacccggaatccatagcttttaatccggtgatctagttcagcaacttctacaacgtagttcgcatcttcaaagagcttgccacccttcgtaatttcgataaaccggatgcgataagccagtttagtttccgaaatccgtagcgccgtcatcacaaaatccttaatccccgctggcccataaatggttaattcagaatcgccaccttgatttgagcgactactcaaaaaaccaggcaatccaaaaatatggtctccatgcaaatggctaataaaaattttgtcaatctttcgcggacggatattagtttttaaaatttggtgttgggttgcttccccacagtcaaatagccaaacttcgttactttcatctaataatttcaatgccacactcgtgacgtttctaaaacgaccggggcttcccgctcccgttcctaaaaattcaagttgcatactttcacctatacactgccttaacatccattttttacttaatttaattgtatcactagcatccgtttttcttttaagctattcttattttagcagaaccgcttaaagaatattgaggagggtttcactaatgaatttaagtaactttatcaaatccaccgtggaacttcattccaacctgattctcaagggcgaacaacaaaaggttgtttccataatcaccaagctaaccctcaccaatgacggtcaaaccattttacttcacgtggctaaccgaccgtcaagtcattccggcttaaccttaggccaattacgcgcccaaacccgcttggctcagcctcaagccaagcttcggctggtaaatcccacaagcggactaaccagtcccctctttggctattacctgcgtaaacaatttttaattctcaagtgaaaaatcagtgattaaccccgcacaaatgttttgttaatttgtgatggtattcaatcactgatttttgctattctacaaattcaaatacaaagtctaaaatctgtacgctgtccccatttcgagcacctaagcgccgtagttcatcatcgattcccatccctcgcatttgccgtgcaaagcgcaacaaactttcgtcgtgggtggtatccgtcatcttaaagagcttttcaattttagctcccttaattacccagacaccgtcttcgttgtcgatttcaaagtccttgtccgcgttaaattcgtaggtcttatcggtcgaatcggctgaattatccttaactaccgttggctgaggcgtcgattctaagacatcggctgtccgagaaatcagcttgctaaggccttcatgcgtaatcgaagaaattgggaagatctcaaaatcacggtaacgttcatcggcccgaacctttttctcgaattcggctaattgctcgtccgcacccggtaaatccatcttggttggcacaataatttgccgccgcttaattagatcggggttgtatttttctagctccgcgttaatctgttcaaaattagtaaacggatctgcttcggtaagcccactcatatctaccaggtgaagcaatacccgagttcgctctacgtgtcgtaggaattcaaacccgagccccacgccctgagaagctccttcaattagtcctggaatatcagcaataacaaagtcacgtccgtcatctaactgaaccatccctaagttaggtactaaggtagtaaagtggtattcagcgatcttaggttttgcactagtaactactgataacagcgttgatttgcccactgatgggaagccaagcagtccaacgtctgccaaaactttcaattctaactgcaattccagttcctcgcccggttcaccattttcggcaatttctggtgccggattccgtgggttagcaaaatgcatattaccccggccaccccggccacctttggcaactactagttcttgaccattttctgttaaatccccgattactcggccagtagttaaatcccgaacgattgtcccacccggaaccataattactaaatcttcagcactccgtccggtcatttgcttattcatcccgtttttcccggattcggccttaaacttgtggcggtaacggaaatccattaaggtgcgcaaacccggatcaacctttaagattacgtctccgccgcgacccccatcgccaccggcaggtccaccattaggaacgtacttttcacgccgaaaggcaacgattccgtttcccccgttaccggccttaatatttattttaacttgatctacaaacatgtttttctcctaatcttttttaactgcgttaaccgttagtcaccgcttcaccgcacttagcgaaattttaatcgttttagcaaccttcgcagagattcccaatgcttcgatttcttcaattttagcgtcccgaatcttattcagtgacccaaattcccgtaaaagcttgttacgtgtttttggtccaaccccgttaatcgaatctagttgcgatgataacgagtttttggcgtgcatttgccggtggaaagtaatcgcaaaccggtgcacttcgtcttgaatccgttggactaggtaaaatccctgactcttaggatcaagctgtacccgctggtcttgatcaccaaagattaaatctgcggttttatgcttatcattctttaccattccagcaaccggaatgtgcaaactaagctcattcaccaacacatcgcgcgcggcatttaactgtacatctccgccatccattaaaatcaaatcaggcagcgattggtgttcctttaatagtctaacataccgacgccgaattacctcccgggtactggcagcttcatccgcgtgatcaacagtattcagcttaaacttgcgatacatcttcttgtcgggtttgccgtcggtaaagaccaccatcgccgaaactaaatcggctccttgaatatgtgaatggtcaaaagcctcgatccggtgaccctcggggattcccagggcatcggtaatttccttcatggctcccacggttttgctttcgtcaagctctaacaaacggaacttttcttctaacgtaatttgggcattctcgcgagccaaattcattaagtcccgcttttcccctcgtttaggcgtgcggaccggcactcctaaaatttcgctaataatttgattgtccaatccttctggtaccaaaatttcattaggcaacactttatttttattattgtaaaattgcaaaatgaacgaagaaaattcgtcagccgcatccgaagcaattggaaacaaccgtttctcgcgcttcatcaaccgggattgacggatgaagaaaatctgaatggataaccatcccttatccaaataaaagttgaacaggtcccggggggtgcggtcgttagaaatgatccgctgcttttcaacggtaacttcaatgtagtgaatctgatccctaatttcagctgcccgttcgaattccattgcctcagaagcttgctgcatttttgcctgcaacgactttttaactttagcaacgttccctcgcaaaaaggacttaattttagcaatctgttggtcatattcttctttaggaacctctttaaagcaggcccccaggcattgccccatgtggtaatacagacagggccgtccttgatatccattacaacgccgtaagggataaaccttttctaaaaaatgaagcgtttcttcagctgcgtaaacattcgggtacggtccaaagtagtatcccccatcacgccggacgttagaaacaatttgcatccgcggatccttttcatttgtaattttaatgtaaggatatccggttccctttttcaacttgatgttgtaatagggctggtacttcttgattaacgtaatttctagtaaaaatgcttccttatcactggcggtgacgatgtagtcgaaatcagcaatttcacttactaatttagccgttttaccttcatgactgcttttaaagtacgagcgcacccggttttttagattcttcgccttaccgacgtaaataatttgactattcaaatttttcatctggtaacagccgggtttgtccggtaacaaagccaatttatgctcaatatgctctgacgccaaatcactgcctcctagtttacataattactcgtaactcataacattatactctgatttaaccataattatcaatcaaaaggaaccattcccattacatagtaaaacccccgccgttaatcgcaaaaatcactttgggggttttaaaattagtcgggccaattagtttattgcaagttaattttcgagagaaaatcctgggcccggctagtttgtggctgagcaaaaaagctatcgggagttcccttttcttgaatattagctgcatccataaaccaaatctggtccgagaccgatttagcaaattgcatttcatgagtaaccactaccattgtcataccggattgggctaaatcccgcataactgttaaaacttcgccaaccatttccggatctagcgccgaagtgggctcatcgaataacattacagccggttccatcgctaacgcgcgagcgatggcaacccgttgcttttgtccgcctgacagatttcccgggtacgcatccgctttatctgccaagcccaccttttctagcagtttttgagcctggccccgggcttcttcttcaggaatttcctttacccgtcgtggtgctaatgtaatgttttccaacaccgtaaggttaggaaataaattaaagttttgaaaaaccatgcccaccttttgccgcacttcttcaatttcacgtaagcttttttctactaggttctgtccttcaaaaaccaccgcgcccgcagtcggcctttctaacaaggttaaacaacgcaagaaagtgcttttcccggctcccgaaggaccaatcacactaatcacctcaccttccttcacctccgccgaaacgtcttttaaaatcacgttctgcgcaaacgatttagttaagttttcaatcttaaaaatagttttcgtcattagttaaacttcccttcgtaaaattttaataaccgcgatagcgagaaagttaaaacgaagtaaaggatcatcgctactaaaattggtgcaacgccccgataagtatccgattggacaatttttagctgataaattaggtccgtcaccccaataatggaaacaatcgaactttccttgattagggaaataaattcattgccaagcgctggccaaatattttttaaggcctgtggtaaaactacgaaacgcaaccggtcttgataatttagtcctaagctttgggctgcttcgacctgtccttcatcaaccgaattaattcctccccgaatcacttcggcaacgtaagccgcactatttaaggaaactgcgatcatcccagcagtcagcgccggtaaattcactacaattcccagaccaaagtaaaccaacatcagttgcaccattagcggagttccccgaacaaattctacataagccaacgcaattgcccgcaggctagtgtgtcgactcaagcgcattaaggctagcagcgctccgattattgaaccaaaacaaacgcccactaacgaaattaagatcgtgtatcccactccaagtgcaaagtacttccaataatggatcatggaggtgtctacagtattgccttttaaataagttcccgccgtttttaagtattctggtaaccgtttttgcttttttatccgcgcaatggtctggttaattttagcttttaaaactggagagcccttaggtaaggctactgctgtgctagtttcgtcatcatttaatttaaaatgggcgttgagaatctttaatccccggttatttgcggcgtaggcctccgcggtgggcttttccattacgattccatcgaccttattagtttgcaaggccaaaatcaaatcagttcccttctcaattccccttaccgaagcccccttaatttgctttttggcgaggttatattggattgaccccgtttgggcagccaccttccgttgatgaaacgagtttttatccttaaataaatgcccgtccttttgattgataataatactttgaccgccttgataataaacgttagaaaaatcaaccgatttccgtcgagctgcactaggattcattcctgaaagaaccatatcaaccttgccagtttgtaatcctactagtaaggaatcaaaatccatgtttttaatttttagttttactcctagatcgtgggcaatatctttagcaacgctgatatccattcccacgtccttactttttccattactagaagtttgaaactcataaggcgcgtaatctgggctcgttcccaaaacgatatatccccgctctctaattcgttgataagtggggtctttcgtcgtagcgtgcaccgtgtccgctatggcaactcccgtactaatcaaacataatgaaaatataatgaataaccaattaaaaaatgtcttctcttttctcatcgcagtctccttattcatgtaatgtttattaatatacactatgaatactaattacggaagaccgcttgcgttattttgaattattattcataatagcctgaatattagttatggaaatgtatatttctgacaattactaatatttttggtatgatatgcgcaagggagtgattatcaaatgggattaaccgtaaaaagaacgaccgatttagaaaaaatgctggggcaatttactaatccggcaaccactactgaagaaaaaaagaagaaagataaatttttagctaaagataaagacaaaaaaggacaaaaaaaataaccatcgttaccaacttgcttcatttcacgaggccattggtaatgatggttttttattttttatttaaagctgtgcgggtaccgttttgctaagtctttaatgtttttttgagcaacctcttcaaaaggaatgtccgcccactgtgcgacttgggataaataccaaagtacgtcgcccatttccttggttaactgttccttatctaaatcatcgccccggaaagtatagtttttaactaaattaactacctgaccactttcacccgctagccccaaagcacaattcgttaatacttgttcattgcctaaaagggttttattagctttcttttgatactcgttaaattccatttctaatcacccatcctatcttcaatccattgccaaattgcgtccttgccaaacttagtttgcgcagaaaacatttgaaacgcgtcttgctgatcaaaattaaggactttttttatccggctttcatgctgattccattttccgcgagcaattttatcactcttagtagcaaccactaataccggaatatcatagtagcgtaagtattgatacatggaaatatcatcatcagttggatcatgccgagcatccactagtgaaattactcccttaagttccttgcgagaagtcaaatatttttcaatcatccgaccccatttttcccgttccttttgggatacttttgcatatccgtatccgggtacatcaacaaaaaagagttgatcttcgacccggtagaaatttagtgtctgtgtctttcctggttgtgaagacgtccgcgcgtacgacttccggttgatcaacgtgttggtcaacgaagattttcccacgttagaacgccctaccaaggcaatttcggggtagccttgttcgggatactgttcaggctttacagcactaatttgtaactctacattatggacttccattaaattcccaccttccaattccgcctttaatcataacacggattcaaaaaaaagaaccaggcttaagtaattcacctagttccaatttttgaaattacgatgcttgttcgttggttagttccacttctggttctacgccgtcaaccaccgttttcttgttaaccgtaactttagcaacgttatctcgggacggaatttcaaacatgatgtcccgcatcacgttttcaataatcgaccgcagtccccgcgcccccgtatttcggctgattgcttgttcagcaatcgcgtgcaaggcttgtggggtaaacttcaattcaaccccatcaagggcaagcaaggctttatattgcttaactaaggcgttcttaggctcggttaaaatccggactaagtcttcttcagttaatttttctaaagcagttaaaattggtaaacgaccgataaattcgggaatcaaaccaaattttaacaagtcttcagggattacttgttgcatcaagctcttactttcatctaacgaagtgcttgcattcgtttcaaacccaatcgtcttatcgcctaagcgattctttacaattgtttcaattccgtcaaacgcacccccgacaatgaataagatgttggtagtgttaatttgaatgaattcttgttgcggatgtttccgtccaccttgaggaggaacgttagcaatcgtgccttccaaaatctttagtaaagcttgttggacaccttcacccgaaacatcccgggtaattgaaacattttcgctcttcttagcgattttatcaatttcatcgatgtagataatcccgtgttcggctgcttcaacgtcataatcggcattttgcaaaagcttgagcaagatgttctcaacatcttctcccacgtaccctgcttcagttaaggtagtcgcatccgcgattgcaaacggcacgttcaagattttagccaaactttgagccaagaaagttttaccggaaccagttggtccaattaaactgatattacttttttgtaattcaggaccatcatccttagcatccgcctgggccattttgttaatccgtttgtagtggttatataccgctacggataacgtctttttagcctcttcttgaccaattacgtattggtcgaggtaatcaacaatttccgcaggagtcgggatgttagtgatttcagtgggtttcttttccgaagcaagttcttcgtcaatgatttctttacataggtcaacacattcattacagatatatacatctggaccagcaataatcttttttacttgatcttgcgttttaccacaaaaagagcaagcaatttggtcagatgtctgttgatcatcatacaatcctgtcacctctcaaatatttatacaaccatcatagcagaatccctaaggatacgccaatttaaacgttttgctagctgatggcgcatttatcctaaataagtagaaagaggctggaaaattaccttttccaacctctctagtaccaccgttaactctttaaattaccggtggacaattcgtagccaacttggttacttcctactttaaaaaattcaattatttcttagcactcttcttagcttttgacttaggttcttcaattgcagaatccttaatcaagtcaacagcttgcttaattgctacatcatgtttaaccatgtcagcagtcaatgcagagcgaactgctttttcttccatgttgtattgttcagctaagctcttgtattcagcatccaattcgtcgtcagaaggatcgatcttttcagcttcaacgattgcttcaagaactaaggttgtcttaacccggttttcagcaccttcactaagttgttggcgaagttggtcttctgatgaaccagttaattggaagtacatgtctgggctaataccttgttgttgcatgtttgcaagatattggttaacttggcggtcaacgtcttcacgaagcattgcttcaggaatttctttgatttcagcattgtcaacggctgcttggattgcttcgctttccttagcttcgtcagctgcttgaatcttacgttccttgatttggtccttagttttagccttcaattcttcaagtgaatctacgtcttcatcaacgtccttagcgaattcgtcgtcaagttctggaagttccttagtcttgatttcatgaatcttaaccttgaatagcgcttccttaccttgaagttcttcggcttggtaatcttctgggaaggttaccttaacgtcaacgtcgtcatccgtgttgtggccaattaattgatcttcaaaacctgggataaaggagtttgaaccaagttctaagtcgtagttagtggccttaccgccatcaaaaggtacgccgtcaattgaaccatcaaagtcgatagtcactgtgtcgcccttttcagctggtttgccttcttttaagactaattcagcttgttgttcacgtttcttttcaatttcttcgtcaacttcttttgaagttacgcgagtgctttgcttgattaccttaacacccttgtattcgccaagcttaacttctggcttaacggtaacaatcgcgctcaatacccaaggttcgcccttttcaagcttttcaacgtcaacttgtggttggtcaactggttcaataccagcttccttaattgctgctgaataagcatctggtaatacgatgtttaaagcatcttggtataaagcttcttcaccataaagtttgttaaaaatttggcgtggtacatgtcccttacggaatcctggaacatttaaactcttcttagtacgttgaaatgctttgtcaacgccttctttaatcatatcagtaccaacttcgaaagttaatttaccttcgttagtacctgttttttcccactttgcagtcattgtgttccctccgacaaatgatttatttcattacaattctggattgcatacgcttataatcttaacgtatataattcaaaaagtaaatatgaatataacaaaaaaacccgcaaatagcgggtttttcgcgggactaatgtaaatattagtcgtcgatttctgatacaacaccggcaccaacagtgtgtccaccttcacgaacagtgaacttagtacctttttcaatagcaactggttcgataagttctacagtaaatgtaacgttatcaccaggcataaccatttcaacgttgtcaggcaattcgataacacctgttacgtcagttgtatggaagtagaattgtgggcggtagtttgagaagaatggagtatgacgtccaccttcttcttttgatagaacataaacttcacccttgaacttcttgtgagtttggattgagccaggagcagccaatacttgaccacgaacaacttcgtcacggttgataccacgtagaagtgcaccaacgttatcgccagcttcaccaacgtcaagagtcttacggaacatttcaagaccagtaattgtagtcttcttaacgtcatccttaagaccgatgatttctacttcgtcaccaactttaacttcaccacggtcgatacgacctgaagcaactgtaccacgaccagtgatcgtaaatacgtcttcaacaggcatcaagaatggcttgtcagttgaacgttctggcgttgggatgtattcatcaattgtgtccataagttccatgataactttttcttgttctgggtcgccttcaagagccttcaaagctgaaccgcggagaacaggaacatcgtcaccagggaaatcatattcagatagaagttcacggacttccatttcaacaaggtcaaccaattcatcgtcatcaacaaggtcagtcttgttcaagaatacaacgatgtagtcaacaccaacttggtgagcaagaagaatgtgttcacgagtttgtggcataggaccatcagttgcagcaacaaccaagatagcaccatccatttgagcagcaccagtgatcatgttcttaacgtagtcagcatgtcctggggcgtcaatatgcgcgtagtgacgcttttctgtttcgtattcaacgtgagctgtgttgattgtaatcccacgttccttttcttcaggagcagcatcaatatcagcgtaatctgaagcttgagctaatcccttttctgacaacacttttgtaatagcagctgtcaaagtagtcttcccatggtcaacgtggccaattgtaccaatatttacatggggttttgttctttcgtaatgttcttttgccattaatacgaacctcctgtatgtcgtaagaatcactcagcattcaaatgaataactggatcctttaaaaaatattatactacatcctccacgaaaggcaaagcaccctcagagaatcctctagtattgtataataatcgcctttattttgtaaactaaaatattataattatttggcttttttattaactagtcataatactgttcatgattttgtttaagctgtgaaattgtttcacctcttttccagccagaaactgagcctgcaatgccgccagccatcccgtagccgtggcaaaaacccgctctggaaagggaaatgctaaatcgtacattagccccgcttgctgaatcaataaatctgcctgaaccggatctgcactttgttcaattaatcgcataagttctttacgtaaacgaccgacatcaatttgggctgggaccacccgatagcttttttcgtcaagccaaataaaatctaattcgcgttcaacccgtaaatcaaccaggtcttttagaattgaaacgcgggtaagttggtttaagtacgggtcgactaagttaaaacttgctgcccgaatatagtttttttgtggcaagtggtatgcttgcttaattgcttttatctgatccgctaattgacgatcaccgagatgataaaaatggcgttcatcggcccgcacgctttgcggaaaatcttcctgatagcggacttcggcttcttcgaggcgcgtcaccatcgccggtattttcatctgctgatcggctgacgctaaagttttccacgccacaatgaaattattagtagcaattaacgcccctaaataatccgcaaaaactcccggatgatgcaaaaaattggtcgactgatttgcgaccaattgtaatgcttcagaatattgttgattagcaacgtaaaaatggtttaataattccgcaacctgggtggtaggcgtcttttcgtcaagttcttccaaaatttggattgcttgggcttgtttaccatcatcccagagttctttagcctgggtgagttgttcatcaatttccttcattattttttcttactaacctttttagcttttttatggtgctgattaacttccataatcactggcaaaattaccggacgccgcttagtttggtcgtaaaggtacttacctaatttgtcgcggacatcttgtttcaaatgcccccaatcaaattctttgttatctaagttagcttgcacggttttcttaaccagtttagaactttcttcaattagatcgccgcttgctttaacatacacaaacccttttgaagtgatcttaggttccttaataataattttcttcttccgatcaatggtaactaccgcaacaaacactccgtcttcggaaaggatttttcggtcccttagcacaatgttaccaatgtcaccgaccccgattccatcgatcattgtattgccaacttcaatacccttaccatggaacatttcaccatcctggtactctaaaacgtcacctttattgacgatgaaaatttgttctggtttcattccaacctgttcagctagttcttggtgagccgccaacaaacggtactcaccctgaattggaatcaaaatctggggcttaattaaattcagcatcaactgtaaatcgttacgacttgcgtgcccgtttgcattagcgcggtcagaaatcgacttaacttcggctcccgcccggtagagcatatccttagtcttcgcaaaggttgtttccattgcgtgggaagggttggtagcaattaaaactaaatcaccctgctcaattcgtaattttcctcgacgacgagaagccattttttgtaaggctttgattggctcgcctaacttacccgtttctaaaacgatggtttcttctggagcaagcttatcaagtttatttaacggaacgattaggtcatcgtctggaatattaatcttattcaatttaatcgccgtattaacgattttttctaaatcgtgacccgtcaaaacaactttgcgtcccgactgaacagccgcgtcgattacttgctgaattcgtaaaatattcgatgctacggaagcgaccactactcggccttcgtgatacttgatgatttcagcgatgcttgctgcaatttcggtttcgttagaaggccgttcaaagttttctgcgttagctgaatcactcaataacgcaattaccttcttagtaccaatttgggctaaccgtccaaaatcagtcgcgtatccatctgtagcggtttgatcaaacttgaaatctccggtgtatacgattcgtccttcatcacaatccaagacgattcctaatgaatctggaatggtatgcgtagttttgaaaaacgagaccgtcacgtccccaaaatcaatttccttcttctcgtccaccacgtggaagtttttaaatttgcgtaagtcggggtcatcattgaccgtaatttttgccaacgcaattgtcatttccgaaccgaataccggcacctcaatttcctttaaaaagtaaggtaatgctccaatggcatccgcatggccgtgggtcaagaacaccccgacaattcggtctttattttcaactagatacgagaaatccggaattactatgtcaattcccaataactcgttttctgggtacttaagcccacaatccaaaatataaatatcattatggatttcaactgcatacatattttttccgttttcgcgaacgccgccaaacggaatgatttttataacatcactcattttttcacctacattaaatattctttagtttccgcacaacttatatactgctttaattttagcatagattaattgtcaaaaacaaaaagcacgcaggaagactttggcgttcactttatctatacggcaaaatttatctaacaaatttctctaaattgactacggccagtgcttggtctgccgttaacacattagtaaaacaaacccatcccccatttttaatgccgctcatttagcaattaggtgattttttatttaaaaatttacttttcgcttccaaataaaaagcagtctcgcgctccggagactgctccaatttaactaactattttaggatttcaataatttattaaccagctgattaagtcaacttaattattaagcagaactccctcgtatttttctagtgcaaacaaaaaagccccgcatcgagatgcagagggctttatctgaccaatcttaacgacgaaggccaagactcttgattaattcacggtaacgttgtacgtctgtcttacgtaggtaagcaagtaagttacgacgatgaccgatcttcttcatcaatccacgttgtgaatggaagtctttccggtgaacacggatgtgttcgttgatttcgttaatgtctgctgtcaaaactgcgatttgtacttctgcagaacctgtatcgccttcgtgacgagcgtattttgcaacaatttcgttcttctttgcttgtgaaattgccattttatccacctcattctttaaattgcccaagactgagtaaatcgtcggcagatcgatagactaagtaatgggtttgcttttataagcacatcctagtttaccgaaactcaaaacttttttcaagtttattcaagcattgcattaataacgtactttctgtataatactactgttgtattaagcatactctggaggtgaataatatgccagttatcaaatctgcaatgaaacgtgttcgtacaaacgaaaaagctgctgctcgcaaccgttcgcaattgagcgcaatgcgtaccagcatcaaagcatttgaaattgctgctaagaacaacgctgaaaacgctaatgaacttttaaacacagcttacagccgtattgaccgtgctaaaacaaagggtcttatcaaggctaacaacgctggacgtaagaagtctcgcttagcaaaaatgcttgctaaataaaaaagcaccggtgatccggtgtttttttattgccatccatttttaaatttaactagaaacaactcaaagagttcctgcgggggtctttgggttgtttttaattgctcttctaaatcaagcaatccgagaaaagcacgtttgaggctagccatatcaaattggcgcaccgcctgcatagctaatttaattcggtacggatgggcctttaattcttgagcaagtttaccttgagaaaatccccgttccgttaaaattttaacctgtaagagtaaccgaaattgactaactaaggcggcgttaattcgcaatggttgctcttggttaagcaacaagacggaatagtccgcaatcgactgtcgcacatcccccttcatcaacaccttaatcaaatcaaaaatattttgggtcagacttttgggaacgagtttttgtaccgcctctaggtcaatatgcttcgaatccgctgcgtaaacggtcaatttttccaattcattaatcacttgcgctaaattatttcccgttcgtaaaatcaattcttcgactgccgggctggcaatttgaatttgacgctcgttaacaaactgttgaattaactgccgagtatcagcctctttgggcgggttagcgtcaataacggtggcctgctttttcaaatctttgacgattttttttcggccatccaatttctcatatttagcagcaaacactaaaatagtcgtgggttcgggttgcttcaagtaattaattaagccgtccaaattaaacttaactttagttttttcaccagttagaaaaaccggattattagcaatcaccagccgatagtccccaaaaaatggcgaggattgcgcatcgtctaataacaagcctaaatcggtattttctaagtcgtacgttccaacattcatcacttgctggtcttctgggattaacgcggttagtatttttttggctgcgttttgaatgtagttatccggcccttcaatcaaatagattggctgaaggttacctttagcaacatccttttttaaatcagtaagtttcattgaacaatgcttccttttttatcaattcctaccttccatcttcccataccattgaaaaaatatctataagaaatcatcccgtaatcttgggtagaaacgaccggaattcgcaatcgttgcaggcgctcaatcacttccgcatttggatggccgtaccggttatttcgtcccgccgaaacgaccgctaatttaggggaaattgcggataacaattcaggcgaattagcagtcttgctgccatggtgtcccaatttaaaaatgtccaccttaccaaccaattctggattttgtagtagtttctgttcaccactaatgtctaaatcaccagacaataaaattctttttccgccaaatttaccttccagcactaaagaatcttcgtttgcgcccttccccggccgttccggatataaaatttgcagcggtagtcgggaaacttgagcaccttttaaaacctcaacgatccgggtttggtggagatagggcaaaatttggtaacggaagttatccgttttttctaccccggcgggaaagagcagctgttggacctttaaattttgcaaaaccgcctttgcttctccaatgtggtcaacgtcttggtgggtcaaacaaagtgtatcaatcttactaatgccgatgctttgtaaataattaattgaactattcttagcaattgtagaggtctgcttttgccgggagccaaaccgtaacttaccacccgtgtccaccatggttaccgatcggttaaaaggctcccgaattaaaatactgtctccttgaccgacgtcaaagaacgtaacctctccaaaaggcagtaaacgaaaataaactcccgtcgctatccaagttaaccaataaactttaaaaagtcgtttcttcaaggtctgtgcatccgtggatacaattttaagtgcaatcactaaaagaaacatcaccaaccagcgactaggctttccgattagtaaaagtcctggaagctgatctaaccgttgcaatccccactctatcccgataatcacctgattaatcacgctggcagtgagtgggaaacaaaaagctattaaaacagccgggatcactaagcttgaaaaaatcggtacgcatagtaaattaaaaaggaccgtcaaaaggtgaattttgtacatcgaaaagaggataatcggtatttctatcaaaaatagtttaaatgaaatttttaaactgctagtgatactttgactaatcaaaactagggatagcaagtaacttagctgaccacccatttgaagcagcacgaatggattcagccatagattaatcaataaaactatgcaccaggcctctacgccacccccaaaatccaaccgtagtcgttgtgccaccagcttaattaaaattagtgtgactgcccgaaaaaggcttgtacttcctcctccaagcacgaaataaatcggtaaaactaccatttgtatggtaaacaaagtttcccgatcgattcgcaaccagattcctattttttcaatcaacttgatgaagtaaaaaacgtgtaatcccgaaatacaaaataagtgaataatacctaaattacgcagtttttcactattttcttttagaaaatcggtctgctcgcccaaaatgattcccgcgcaataactacgcaacggttctgcaaactgctgacagcggtctaataacttcttccgccagtggtgcatccatgcttggtaactctttaaggggagttgtcgaacattgatcagctgcgtcttgtttaagttatagtagacctttttaccgtacataatgcggcgaaaatcaaattggttcacgttggttggttgcgctaacggtcccagatttcccgcaacttctagttgtaaatcttgcgaattattttggaagctttgctgtaatttgggggactccagcgggataaaagcctgaactccttggtgatcaaaactattattaaacgctcggatgctgatcccatcttctcgaattttgacctcatcagggtgcacgtttaagattatccgcacattttcataacttttctgatgttgcccgataaaatgactcacgtgactaaaatgccacccaaaaagcaatcccaacgtcacaacttgtatcactgggaaaagctgccgcaaccaacaaacccggccaaaccaaacaaatagcaatactaaaaaaactattgaacgagtaaaaacgtatcccgccagcaaaaagatcgtcaccgttgcccaaattaaagaactactactttccatcctttaataaagttttgatatcgattttagctaaatcttcgtccgtaaacttaatttgcttaacggcaacgtttttacgtttcaaaagtgctactgcataagggtcgttattatagtttcgtaaataattaattttcacgatgcccgtttgtaaaagcattttagtacattgcagacacggaaagtcggtaacgtaaatctccgctccgtcagttgccacgccaaatttagagcattgcaacaccgcgttcatttcagcatgaattgtccgcacgcaatggccatcaactaagtaacatccttcgtctaagcaatgcacgtcgccgctaaccgatccgttgtatcctccagcaattacgcgccggtcgcggacaataattgctccgacagaaagccgtttgcacgtgctccgtagcgataataatagtgcctgtgtcatgaaatattggtcccaatcaattcttttatccattttaaccatcctttttaaaccgtaattgaatcctttaaacctgcaaaaattttatcaccaattccttgaacctgctttaaatcatcaatggttttaaagccaccctgttcttcccgatagctaataatctgatccgcctttttatctccaatcccgtttaacgttaacaaagcatttttatcagccgtattgatgtttactaactcaccagccgatgaagaacttgccaggctttcatttccagcattgccagcggttcccattaactgcttaggatcaaagtccttaatttctcctttaatgggtatgtacactacctgttggtcacttaattgtatagccatattaatgtttttgcggtccgcagattcagtcaatccgccagccagttcaattccgtcgacgacccgcatccccggttttacttcataaactcccggttttttaaccgcaccctttacgtccaacattagcttctgcttaccagctgatttttgaacactatcagtcgaagggttgctagttacagagctagattgagcttccgaacccgccatcatcacttctgagttttcttgtggggactgcacagtattcttcggccgtagcaaactaacaactaacaaaatagccgccatcaagatgcttcctattataattggtttttggtatttttcccaaatttcttcccacattttcacccctcctcaactatatatacaaaaaaagaccggattttcttccagtctttagtttatttattttttagtcgacttttaagctgtagctccactgcttccggtactaacccgtggatgctaccacccattttcaccacttctttaattaaacttgaagaggtaaagttccatttaggatcagctggcaaaaagacggtttcaacttgttcagctaaaaattggttcatttgtgcgacttgtgtctcaaaatcaaggtcggcggcgttccgaacgccacgtaccaaaacgtccgcatttaattctttaaaagtatccaccgtcaaccctctagacgtggtaaagctcacgttctccaagtcctgcatcgccatcgtcaacaagttaacccgctcttgaggagaaaataacggctgcttattagtattaatagcgaccactaccaccagctcatcaaagatttgcgcagcacggcgaatcaaatccacgtgtccgttagtaaccgggtcaaaacttcccgcataaagtgccttcgtcattatgttttgcttccttacttaaaatattttatctagctacccgccttgtagataacaatcttagtaataccgtagcgttgctcgcgtgttttagctaaccagccaatttggtcgggcaattcgacttcttcactagtttcacagacaatggtgacgtctttagcaagtaaatctagctccatcagggacacaatatcttgggcgatggtttgcaacgcgtatggcgggtcaaaaaagaccatgttatacgataccgcctgcttcgctaaattatgaattacttttttggtatcacctttaattatctgaaactgctccggatgtttcgttacctgtacattatcccgaatagtcttaattgccgccatttgcttatcgatcaaggttgcttgttccatgccccgcgagaccgcctcaatagcgagcccgccgctaccagcatacatgtctaaaacggcgccaccggtaaaatatggcccgataatattaaatacattttccttaattttatcagtcgtgggccgggttttcatccctgggaccgcctttaaccgtcggccaccaaaatcaccagaaataattctcattgttcatcttcctctgttatcgtatagtcctcatcgtagttgactcgcaaatcagcgcgtggtgaaatatacgccgtacgcacaaaattaaaactgcgaatttttttcagcgtttccgctgcgtcagctcggttaacatacaaaatcaagtaatgcatctctttggacaaataattaatatcccctagcttcttcaaagccgtaactttttttaggtgactaaagaaaattacgatgctttgccgttcagttatctccatttattttgcttccctttgctctattctttggcttcttttttgtgaagcactaatatttaacaaaacgccaatggtggcagataaaacaatcatactcgaccccccgtagctaataaagggaaaagttacccccgtaatcgggatcaagccggtaattccaccaacgttgaaaaaggtttgaactactaaataagtcgcaattccgtagcaaattaacgtatcgtacatccggtttgacttggtacctaagataattgcccggaaaataatcacgaagagcaccgaaataatgataatcaccataattaaccctaactcttcagctaccacggacatgatgaagtcggtatttgcttctggcaagtatccttttttctggatactatttcctaagccaacgccaaatatcccaccattaccgagtgcgtaataagaattaactaattggtttccggctcctttggatagctcaaacgggtgtgcaaagcccaccaacctttgcagcatgtaattggaggtgttgatgtcaattttagaagctaccgtcgtcaacaacccaaaaaagactgccaaacccgcaaaaattattgcaacactttgccgataatttttgccggctgccaagaagagcacaattgcaatcgctgcgttaattgtggaaccccctaaatcgtgttccaaaaaatttagtacgattagcccgaatacaataacggccgggctccaggtcgtcttcgctgaaatctcgtcacctaattccatgcggtgctggtgcaacgacaagatattggctaagtaaagaatgatgaacagttttaagtactcagccggctgaatcccaaacgaaccaatataaatccaaccagtggctccattagtgttagggccaaagaaaattaagtatattgacgccaaaaatagtgccacaaatgcgaacatcaaaattttcttatttcgaaaaacttttttgttcatcaaaaagactagcaaggtaatcacaaatccaacggctacccacaccgcttgcttcagcaaatagcttttagcgctaatcccattttgaatatagtagtctgcactggccgaatataccataatgatcccaaaaatacttagcaacacgtatggaaaaacgacccataaatctaggtctggaagccgccgctttaatttttgcggcagccaattgataatgctttgcattgttatccacctttatcctaataatactgttctattatatcctatattttctccggaaaattaaaaaggggccgagaaaatttttcccaaccccttcttaaaaagaacttaaacagcgttattttctaacgtgtttacgtaaacctgatattcattattttttagcagccattttacgtttcttagccgctttttcacgttcgttagtatttaagatttgcttacggagacgaatattttctggtgtaacttcacagtattcatcttcatttaagaattcaagggattcttcaagcgtcatgtgtaatggtgctttaaccttagcaatatcttcagaaccagcagcccggacgttagtttggttccgtccccgggtgatatttactgaaatatcattttcccggctgttttgaccaacgatcattccttcgtatacttcggttccggcatcagtaaagattaccccgcgatcttggattgccatgattgcgtatgtggttaccttacctgagttaatggataccaaagtaccgttacgacgacccgggttccaattcttaatcactggtagatattcttggaaagtatggttcataattccgtatccccgagtcattgaaaggaattcggttgagtacccgattaatccgcgtgaaggagctaagaaagtcaaccgagtttgtccgtttccggttgattccatgttcttcatttcacctttacgttgtgaaagtgaatcgataactgaaccagtatattcatcaggagtatcaatttgaactgattcaaacggttcgcacatcttaccgtcaacttctttaaggataacttctggacgagaaacttgtagttcgtagccttcgcgacgaagcatttcaatcaagattgaaagatgtagttccccacggccagaaacaacccaagcaccgggatcatcagtatcgtcaactcgtaaggaaacgtccgtatgcaattcttgcttcaaacgttgttccaattgacgtgaagtaacaaattttccttcccgaccagcaaaaggcgaatcgttagttctgaaggtcatttgcaaagttggttcgtcaatccgcaaaactggcaatgcttctgggtgttcggcatctgcaacggtttccccaacgaaaatgtcttccatcccggaaacggcaattaaatcaccggccttagcttccttaatttccaaccgtttcaagccaaagtaaccaaatagcttagtaacccggaagttcttcttactaccatccaacttcattacggtaacgttatcgccaaccttaatggtaccgcggaatacccgaccaattccgatccgacccacgaaatcgttataatcaagcattgctacttggaattgaagtggttgatcagaagtatcttccggagcaggaatggtcttcacaatcgtgtcaaaaattggtttcatcgtgtgttcttgttctgcaggatctgaggagaagcttgaagttccgttcaaagctgaagcgtaaaccactgggaattcaagttgatcttcgtcagcaccaagttcaatgaacaagtccaaaacttcgtcaactacttcttcaggacgagcaccggggcggtcgattttgttaactaccacgattggagttaagtgttgttccaaagctttcttcaatacgaaccgggtttgcggcatggtaccttcaaatgcgtccacaactaacaaaaccccgtcaaccatgcgcatgatccgttctacttcaccaccgaagtccgcatgtcctggagtatctaagatattaatttgcttgtcgccataacgaacagccgtattcttagaaagaatggtaattccacgttccttttcgattgcgttggagtctaacgcccgatcttcgatttgaacgtgttcatctaacgtgtccgattgttttaacaattcattaactaacgttgttttaccgtggtcaacgtgagcaataatcgcaatatttctaatatcgtctcttaatttcaaaatttgtttctccctttcgttttgcaatggctttacataaaaaaacctgtgactcattgttcggtcacagcacaagctcattttactatgttcattatagtagcaaatgcctttttcgtagcaactagtacaacgcccgattttagcatattaagtgggcttccgtcaatacggtcaaccatgagtcccaataccatcgctaaagcgtttccagccgcaaaatcccacggtttaagcgtggatgcatagccgacttgcttacctaaaatcactcggctaaattcaattcccgcacttcctaagacccgtgaacctaagctttgtgcctcaattgtttgaaaattaaatttatttgcaattaacatcggaccgcttagccctaccaatccctctgctaacggcagattttccggcgaggtaagtttcacttcgttacaataggcggcacccagtcctggccctccatgtagcaatcggtcacgcatcacgtcgtaaatataacccaaaattgggtgtccgtcctcatacaacgcaaccattacggcaaagtcttcaccctgttttacaaagttcatggtaccatcgatcggatcgattacccacactaaaccagtagaatcagtgatttgacgttcagtttcttctgccaatattttagctggctgcaataacggttctaagaaggcaatgatcctttgctggttttctttatctagcgaagttactaaatcacgccgccccgttttttgtccaacagcataatgtttttgcatttgttctaaaataaattggcgatcctgccgcaaaaaatcacaaatttgttgatcaatttgttctaattgggttttagtgatatccattttcggtcaccttaataatttttacaccttcatcacgaagttgtttaactgcttgaaacggctgcattcctgaattttgttcaaattcacgataaattcgtttctcttcacttttattcggaaccacttgccgaaatttgtcgtaggcgttctttaacgtttgctttttaacgcccttttgatagctttcttcaattttagtaaagaaatctactacgtccgtaatctcttgaacattccaccgttcgtccaacggatagctaaaattttccttaattcccacaatgctacctcactaaagatttattttgtattctctttaatctatattatacttaatatcagacaaattggaggtttttatcttgattaaaatgaatgatatcacgcgagatggtaatccagttttgcgcaaacgggccgaaaagctgacttttcctctcgatcccaagtatcttaaagttgctgacgaaatgatggaatacctaaaaaacagccaagatcctaaaatcgctcaaaaatatcatttaagagcgggcgttggtttggcggctccccaaattggcctatcaatccaaatggcctcagttttggttcctggaccagatgacgagattatctttgaagaaaccctcgtaaatccagttatcgtcagtcagtccgttcaagttgctgcactcgacgaaggtgaaggttgcctttcagtagacaaagaagtccctggctacgttccccgctacgaccggatcaccattcggtaccaaaccgttgaaggtgaagaaaaaaccataaaactacgtgattaccccgcaatcgtatgtcaacatgaaatcgatcaccttaagggaaccctattctatgatcacattaacaaaaaggatccattttcaattgacgataacgccattttgattggttaaagatcataagaatgacaaaagacgcaggtttctccattattttaggagaagccctgcgtctttttattttctataatttgcttaagtcctttaagtaatttttagtttgctcgttaatcaggtaaactacatcaacctctaaaatgtttttgtttgcccataaatctgaaacacgcaacatcggtccttggttttccattaaatctttcctttgacaatactgtgttagccaataatcaattcggtcacccacatctctaaaattgccctggtcgttaagtttaatcttgtagttaaaccccacaactgcctgtccccaaacatctgctacagacgtaccgcgcttagtaaccaatacaaaaccctgagaacgcatttgctcagccacgaatcccatggcctcatcaacgatggtttcgcctgagttacggacaatcgtcgctgctttcgaaaccctacgccgttttatataaaccattagcgctaacactgccagcacaagcaacaatcccaaaatgattaatttcattgaacgtccgtcctttcaaaaccctaattctatacttataagtaccgctgtgataaaatattctaagatgcgttgtagtaatacaacttattgaacgggaaaaactttatttttattggaacacatttttattgaagaaggaaggaaaaaacatgatctttaaaatttattatcaagaatcaaaaaaagaaatgccacgccgggagaacacacgctcactatatattgaagctgactctcaaccagaagcaattaagcgtgtcgaagaccacaatcccgattttaacctcgaacaaattgaagttttagaggggaaagcccttgaatacgaacaacaaggggtaaactataagcttgtggagtactaagcgatgggtaagattaatataaaaaataacgagacggccgtttatgcaatcggtggtctaaatgagattggaaaaaacacctatggaatccaatttcaagacgaaattattgttgtagatgccggtatcaaattccctgaagacgaacttttaggaatcgattacgtcatccccgattatcaatttttagtcgcaaaccaacaaaaaataaaggctttagtgatcacccatggtcacgaagaccacattggtggaatcccgtttctactacaacaaattaacgtgccaatctatgctagtccactagctgccgccttaatccggggcaaacttgaagagcacggattgttaaaaactaccgaaattcacgaaattaacgaagataccgtgattaagttccctaaaactagcgtaagcttctttaggaccacccattctattccggacactctcggagtagcggtgcacaccccttctggcgtgattgtggaaactggtgacttcaagttcgatctcacccctaccacccaccagccgcctaatttacaaaaaatggctaagttaggtgacgaaggcgtactgttattgatgtccgatagtacgaatgctgaacgtgacgaatttactaaatccgaacgctgggttggtaaatcaatccgtaaaatttttgaagaagttcaaggacgcatcatttttgcgacctttgcttccaatatttcccggattcaaatggccgccgaggctgcgctgaagcacggccgtaaaattgcggtctttgggcgctctatggaagcagcgttagttaacggacgtgaactaggctacttagatattcctgacgaagcgttggttaatgctgaagaaatccggcacctccccgctgataaagtattgattatgtgtaccggctcgcagggtgagccaatggccgccctaagccgaatcgctaacgggactcaccgacaaatttcgattgaacctggtgatacagttgtattttcaagtaatccgattcctggaaacacaatcagtgtaaataacgtaatcaacgaattggaagaagccggagcacgagttattcatggtaaagtcaacaacatccacacttctggacacggtggccaagatgaacaaaaactaatgctccgcttaatgaaacctaaatacttcatgccaatccatggcgaataccggatgcttcaattgcataccgaattagctcacgactgtgacatccccttcgaaaatagctttatcatgtccaacggggacgtcttagccttaactaaagactctgctcggcgttgcggtcattttaatgccggggacgtctatgttgatggtaatggcattggcgacattggtaacgtcgttttacgtgatcgtcaattactctctgaagaaggtttagtggtcgtcgtggccaccattaacctcaagaccaaaatgattgaatcaggaccagatctattatcgcgtgggtttgtttacatgcgcgaatctggggaactcattaatgaaggacggcggcgaatgtttgccacgattcggcaagctatgcgcaacccccacgctaacgaagcttcaattaaccgggcaatcattgatgatttacaaaaattcctgtacgaccagaccgaacgtcacccggtaatcattccaatgttaattatggattaaaatttcaaacaccgctaaatcaaaattagcggtgttttttaatatccaaacgcttgcaatgtggcttaactactccacttaacttgcctacccctacgcaacaatcctgctaaatttcactattgaaaattgattccgtgctaacgagaacatacaaaaaggccccgctagtaaaagcggagccttgagaagacgactgttagtcaatcttattcaactctcccagcaaagcttgggtagaagtatgatgaaattgtttgtactttaacgttttgaccaaaggttggtgcacttgcgtattggttgttaccaaggtaaataccaacgtggtaagttgctcctggagtaccccagaataacaagtcacctggttgagcagctgaaactgactctttgttaacgtatgattccattgctacggtgtagcttggtaagctaatccctgcagcatgttggaatacgtaagatacaaaaccagagcagtcaaatcctgcaggtgtcttaccgccccaaacgtaaggaatggtgttgttagctaacgaagtagccaaaccggtaactgatcctgtgttttggacgttgctagttgctgcacttgatggtgccgctgatgaagcgacgtggtttgttgaagctgcaggagctgcactcgatggtgctgccgatgaagcgacatgattagtcgttgcaggagcacttgatggtgctgctgacgaagcaacgtgatttgtagctgcaggagcactcgatggtgctactgatgaagcgacatggtttgttgctgcaggagcacttgatggtgccactgatgaagcagcttgttgttgcttactaatttgtggagcagctgaacttgctggtgctgcaggtgctacatatatactgtgtgttgaaacggtatttccgctaggaatgttaagttgttgtcccacaagaattaatgagctagtcaagtggtttgcttgcattaaagcgttaactgaaacaccataacgctgagcaattactgaaagactgtcgccactctttaccgtaaccgagtcagcctttactttgtcactaacacttgttttgggttcggcgttgttcttttctggaatattgatttcttgaccaacaaaaatcaagtgactgttttgattaatgttattcaaggattcaatactcttaatggaaactccgtatttttgagaaagtgcccaaactgtgtcgttcttttgaaccttcacagaatcagcatgcgcaactgcttgtgaaccgccagcaacaagtaatcccgcaccggctactccggcaagcaataatttggacgcatttgatttagatttagataccattataagtttgtccactccttaaagttttcgatttatatattatttcattcgactttattcaaaataaattataattggttttgcacgtctataatattagcatttttcgccaactttgaaaacactatttatacatcagatattcaatttttctttaggaattcttataaaccccttcaatacggtgtttaacaaaacttaataaattcaaatttttttgtcccgcttttttgataaaaagcttaatttcaagcatatttagctagcgttacagttttgttacaaaaaaagcacattgttacaaaccttgtaacaatatgctttattgcattaactatttttatgcataaaatgaatatttattagttattagtagtgcgccgtggcttccagattcccataatgaaccctgcaactactgccccaattaagactgataggacgtagaagagcttgtgatccgctaacgcaattacccaaaggccaccatgtggtgcaggaacgctaactttccaaagctgacttagtccaccaccaattgctgaacctacaatacttgagccgattactcggagcggatcagccgtagcaaatggaattgccccttcggtaatgaaggaaattcctaatacccagttagaaatccccgcttcgcgttcttgttcagtgaacttctttggccagaaagttgtcgcaatagccgttgctaatggtggaaccatcccacctaccattacggccgccattagatcaccatttttggttgacgtaaaggccgcaatcgcaaatgcgtaagccgctttattaaacggaccacccatatcaatcgacatcattccggctaagacagctcctaagaggactgcattaccagtacccatgccttccaaaacgccagttacccaagcgtttaccgccgcaaataccgggttaataatgaagaacattaaggccccaactaacaataaactgacaattgggtagaatagcatcggtttcaaaccttctaatgatttaggaatgaagcggaagaacttctttagcgcattgacaattaaaccagccgcaaaaccagcgatcaatccaccaatgaaacctgaaacactattagtatgcataatgcttgccgccgattgggtagccatgtaaccaccaactaccccgggcattaacgcaggtaaatcaccaattgattgagcaataaacccagctaaaattggaattaagaacgaaaaggcgtaattaccgatatcgtttgggaaggtgaaccataagctggttgccgaagtatatcgttcaataaagaacgaaatcgccatgataatcccaccaccaactacgaatggtagcatgtgggaaattccgttcatcaagtccttatatacttcgttccaaaaaccgcccttagattcatcagcagcatcatcgccatcggcttggcttgcatggaacgtgcttgcctgatgattttcgaccatttcaattaattcatcagctttgttgatcccatcaattaccggccgatttagcaagggtttcccattgaaacgcgccatttcaacctttttatcggcggtgacaattactccgtctgcacgttcaatatcttccttagttaaacgatgctttaccccttcggaaccgttagtttcaaccttaatatcgattcccttatctttagctgcttttttcaaagctgcttccgccatgtaagtgtgggcaattccgttaggacaagctgaaaccgcaacgataaatggtttttgggttgctgaagtttcttcagttgcaggagccgcattcgttgcaggagcttcttcctgagcgtctgcagcatcttcggcatccttcgccgcttccgcttcttcaaacaatttaatcacgtcgtcagcactttccgcttttttcaacttcgcaactaggtccgggttgattaacaaactggaaagttttgccagcgcttgtaaatgggcgttattcgcgccctcaggagctgcaatcataaagaagaggtggactggttgtccatctaaggcattaaaatcaacgccttgactgctcttagcaaataacacggctgcttggttaaccgcatcagttttagcatgtggcatagcaatcccatcaccaattccggtggtggattctgcttcccgatctaatatccctttaagatacttcgcacgatcggtaacgactccttcagccacgtacttatcaatcatttcgttaatcactgcttcttttgaatcagcttttaaatctagaatcatcaaatttggtttgagtagatccttaattttcatccttcatgcctcacttttcaaaaatttcaattgcgttagcaacttcatcaatcttagctttggtggcaatgtctagtgaaaaggccgttgcactaccacaagctaagccttgtttaaaggcccgttgcttatcgtgggatttaaccaattctccaacaaatccagcaagcattgaatcacctgccccaaccgaattaacaacggtgcctttaggtgcaaaactgcggaaaacctgatcctcagtaacgagcatccctccttcgccagccattgaaatcattacattttgagcgcccatttcaattagctttttaccatattcttcaatttggtcatcggaagttagctttaccccgaataaatctccgagctcatgattgttaggcttaacgaccagcggatggctatccaacgtatctaacaaaccttgtcccgttgtatcaaccgcgaagctcgctccattttggccgattttcttgataatgtcatcgtacaaagtttgtggtaagtttgctggaacactaccggagaaaaccactacgtcgcctgccccaacctggtcgaacttggccatgaattgacttagctcttcatcgtcaatattaggccccaacgcgtttaattccgtttcttgttgagcgtgaattttcacattaatccgggtatcttccttaatgccaacaaaatcggaatggacctttaattccgtcaagacgttagccacaaattgcccggtaaatccccctaaaaacccaagggcggtattttccacatctagttcattaagaatccgggaaacgttgatccccttccccccaggaaacttacttgcagacttcaatcgattaactagcccaacttgcatttcgtctaagctgattacgtaatcgattgagggattaagcgttactgtataaatcatttttgaacctccaagtaatttagttgctgatcagtttttaaccattctggacattcgtcagcaatgatggttacgtcctgtaaatcagcaaaccttgcaaaagaagtctgatcaaatttactacagtctgccaaaacatatgcgtcccgactttgttcaattgccgtggatttaatttgcgcttcctgaatgtccggagtggttaacccttgaacacggtcgattccgttcgttcccataaagcagcggtcaaaacggaaagtacgcaaccgatcgaccacttcagcgccgattaacgctcgggtcttgttttttagttgtccgccaactaagtaagtctttatatcaaaatcagacaataagctagcaatcgataagccattcgtgaccactagcaaacccttgagttccgctaaataagcaatcattgaagcggtagaagtaccagcgtccaaaaaaatcacttcgttgtcttggacaagttccgcggcccgtttaccaatttcattcttttctagtaagttcagtttggactttactcgaaaatcagtttcatcttgtaaattggtttctaaacgagctcctccataaatcctcttcaactttccggctgcttctaggcgttttaaatctcgccgaacagtggagatagaagcgtcgttttcttgcataatttcattaaccttaacgaattgacgttcttttaacattcgcaaaatgtttttctcacgcagttctgtaagcattttcatcaactccctaaaagaatatatcatcattcttcgccaaaatcaatcaaaattgttcaaaataattcatttttgttcaaaaagattcaaacgagcgtggatttttatattttcatcctctggtatcggattctttacaaagttacgcgcaaaaaagtgacccgggaaaactaaaaaatcctttttagggtgaaactataaaaaaatttaacgggttgcctttaatagcgtcaaaagtcaatccgttccgcttaacaaaaaaacgaccatatgccaatttaggcataatagtcgtttattaggtaagacgcacaagctagccgtcttttattttccataaactattagtttaaattattcaaattcctcttcaatagcttctttaggatcctttggccggcgtcttttgatcttaattcctaacagatcaataaagaaggccaccgtaggaattcccacgattaacccccacgttccaatcatctttgcgccaatgattaacgtaatgaaggtgacaaacactggtaaatctgtggctcccgccattagtcgaggatgtaggaaatacgattcgaaaaagtggattaccgccactaacgctaacacttcgactactgaaaccaatccatttgccgaaaaagccacaatactcaacggaattaaggagatcaacacccccgcgaccggtatcaagcctaaaacaaaaacaatgatggccatcaacaagagtttaggaatcccaattatccataaaccaatcaccatcagtccggtattaatgctacaaatgattagctgcgtctcaatcacggtccctaaaattaaaacgtactttcgtaacaaataatatataagtttaaatagcccttggtatcggctatgtaaaatcgcgtgtccaaactcccgtaagtggttgtaagttaagttgaaaactaagcttaagaataacgcaatcatcacgtgttcagccgcaatcccaatccggcctaattggttcaatcccgacatggcaaggtgctggctgcccttaaccgccgtggtgttttttgcaatttcattaatgattccttgaaaatatttgttattaaaagcatcgctgttaatcgcttgcccaatcaacgcggggatcccctttaattggtcataaagcattgaagcggtgaaagaaaataccacggccgcaaacgctaacaataccgagtaaaaaatcaaggtaccgagcggttgattgacatgcagatactttcgaatatttttaatacccacgtgggcaacaaacgagaaaatgacaatcagcaaaatttgcgacataaacccgcgtaaaagatacacaattaatagcagagccgccaacgttgtccagagttgtaccgacttcttttgccaaatccttactaaaacgtccattattttcctccaattatatcttaaagggcctgcacaaattataatctgttgcaggcccttttggaaaatatttattaatatttaatggttatttaattagtttttgcttttaaatagcggtgcgagcggttcgttgttgtaaatcatcttgattgcgttccctaataaaggtcccactgataattcgactaacttttcaaagcgcttctcctcaccaatcctaatggagtcggtaacgatcactttagatagcttggaagcttgtaaaatttggggtgcgttccgcgaaaagattgcgtgggtagctgcaccataaatttcagtagcaccagcattatgcaaagcttcggccgaaattgtcagccgggttcccgtatcaatcatatcgtcgatcactaaggcaacttttcctttaacgtcaccgatgatctccgtaggaatttcgttgaggttttccgccgattcttcgttacggttatcaataatcgcaatcggagttcctaataattccgccatgttccgtgcccgagagacactcgcgtggtctggagaaacgaccacgaggttttcagaatcaaaattatgttcttggaaatagcttgctaacaaaggcgccgccgccaaatggtcgactggaacatcaaagaatccttgaatctgcggagcatgcaaatctagagttaatacccgcgtaatgtcatcatcttccaacaaattagcaattaattttgccgtaatgggttcccgtgaacgagccttgcgatcttgacgggaatagccgtaataaggaatcactacgttgatctgccgagcactggcccgccgtaatgcatcaaccatgattaacagctccatcaaagaatcgttaatcggatccgaaattgattgaatcacgtacacttccgccccccgaatactttcttcaatgttaacttgaatttctccgtcgctgaattgcttaatggttgcctttcctaatggaattcctacttcgtttgcaattttttctgctaacgcccgattcgaatttaaagagaatattttcattcttctttttgctttgctttccacggctaaacctccaatttttatctaccgctattatagccatctttagttatcaacttcaacaaatacttaaagaaaatcccggggagtcaccccgttcatcccaatcatcggatcgatttttccggtttctaccagttgtttagtcaaaagagttggttcatccccgctagttgcgaaagtttccgtaacttctggctttgtaaggatcgacttacgctgaggttcccctgcttcgcttttttccgaagtcgttttgggttcagacttttctgcaattggcttttccgttatggcaatttccggattaagtcgcttaactaagccagtttgccggttagccgattcgttttgtacagcccgttggtaagcttctacctcacctagtaaaatgatggagtctgacgcccgggttaaccccgtatacaaaaggttgcgctgtaacatccggtaatactggcgtaccatcggtaaaatcaccaccggaaactcgcttccttgcgatttatgaatcgaaacgcagtaagctaacgtcaactggtttagatcattttttccataggtaacctcgttgccatcataatcaacaattaactgtgcgtgaccctttcccgctttttcggtaactattccagttatttccccgatatccccgttaaaaatattattttcaggtgagttaactaactgtaaaactttatcaccaatccgaaattgctggtgatttgcttctaaatatttagggtgatcagtttgcggggggttaagcacccgttgcaaatgacgattgatttcatcgatccctgcggctccgcggtacattggcgctaaaacttggaggtcgtttttagacagtccccgagccaccgcgcgttccgcaatttgatcgattgcatccgcaacttggtaagcactcgccttaataaacgatttgtcaggacgattttgggtaaaatcatccggcatttctccattttgaatgctgtgcgccatttggataattgaagaatcctgctcttgccgataaattttagttaatgaaattgttggaattttttgactacgaatcaagtcactaaaaacttgtcccggtcccaccgacggtaactggtccttatcaccaactaacacaacttgcatttcggcgttaatcgctgaaatcaaggtattgaacagccccgtatccaccatggacatttcgtccaccacgagaagttctccccgtaattcctggatttgttcgtcgtgtaaatcgtcattcccgttcaagcccaataaacgatggatggttttagcgggaacaccggtaacttcactcaaccgctttgcagcccgaccagtgggagcagccagttgaatgggataatcctggtccggattggcgttggggtcaagatctagatcgtgcagttccgcaaaactattgattagtccctttacaatggtggttttaccagtaccaggccccccagtaataatggtaattccgtgagacagcgccattctaattgcgttattttgagtttcgtcatactcgagcgcaagatgttcttccgcgcgtttaattgcccggtcaaccgctttttcgttaaccttaggaggattcttaagcagatgctggagctggtagccaatcgcttcttccgcttggtaaagccattttaaatagatttgaccgttttctccaaccacccgtccttgtttacccaactcaagtacttgttcagcaatcttttcagcattaatttcgtttcccaatagttgctgtgccctttgcagcattacttccgcaaccatgtaagtatctccggtgctgttacaccactcttgaatcgtggctaaaataccactttgtaagcgtcctggaaaatcaaccgaaaaatttagctgctggccaattgcgtcgacacgcttaaatccaatattttcgatgtcattagctaactgatacggattttcttcgataattttcaaggtatcttcgcgatattttgcaattacgttatcggcggttttgcctgaaatccccaaatccgcgagtttgatcaggatcttctccatcccattggattcagctagcaccgtttcaatcacgtccgcctgcgcgcttgatagtccgatatccctaagcacctgggcattatccttaattacgtcaatggcgtccattcccagttgtttaacaatcttttcagcagttttctttccaattcccttaaattgcgagcccgcaaaatattcaactaacccttccttagtatctggtcctaaccgactagcctggcttaattgaatctgggttccgtacttggggtgttccaccaatttgcccttaaattggtacttagctccctcctgaacttccgccatgttgccagttaccacaatttggggttccttccaatcaaagtcttgatcaaccacgtcaatcaaaaccaccttaaataaactagtgggactttcaaaaaagacggcgttaaccgtcccggttaactccaccattttattcatggaagttgctttttttggaggtgctgctgaaccttcatcaccaaaaaggtttagtttctcaaatgccattaatccgcttcctttgacgaatgcaatagtttatcaatatcgactaagcgttgctttgctttactgaaaaattcgggatcaatttgtttagctttggcaaagtaatcgttatctggttgctgggtcaaggtcatttcgaccactccccggttaaataataatttcgcagtatttttatttttcaacgccacgtcgtaatatttttgggccgcttgagcctctcccattgctaaattgatatcgcccattaattcattagtctctggatcttgctgatgctgttctagcgcagtcaatgcaaatgcaaaggctagcttatactgactttgtgcgtaatacccttgggcaatcattaggttagcgtcgtgccggtattgaggatctttaacggtttgaaatgtagcgttggctcgctcataaagccctgttgcgtaataaacattgccgagcccgtaagtaagtaaatcttggctaggttgatcactaaaaagcccccgtgctttaactaggagttcttcagcttgatcaaaactttgctgtttaaccaaaaccgtggctaaagcataatagttttgggcattgtgtgggtcttgatcaattttttgaattaattcgtgaactaaattttggttttcttcattttctttttttttcgtcatcttttcaccttaaatcacgtctgtaggatccgtttttttggttaagtagctagtatcgttccagtccaagagccggtacgtctttccctgatcctgggtttctaggatagtggtactagtgttggcgaggccgccccgtttgcgtaagtcgggtaacggaacctctaataacgcgttaataatcgcgtttaacgcggctccatggcttacaataattacctggtcatcgtcgccaggattggattcacaaatccgtaaaattgctggacgcattcgttcaatgaggtgttgaaaggtctctcccttgattcgggcggggaaatagcgttcggggtggttacgaaaagcatccacttcttcagcatatttcttttcaacgtcgacaaatttcattccctccatcacgcctaaatcaaattcccgtagacgactgagaattgttaaaggggttgcgtgaccttgcaattcatccagttcgtgttgcaaagtggtggccgtcacccgtgcccgacgaagcgggctggcatatatgtggcggaactgctggggtgctaaaaaagcggctaattgcttaatttccgcgtagctttcttttaaaagcggagagtccccctttgctccttgataacgcccttctaaattccattcggtctttccatgtcttacaaaatataactttgtcaaatctctcgtccctttatcaatgtgtttacccactattttaacattaaacgctagattggtaatagtaacgctagccttttaacggcaaagaaaaaggccggggaaattttcccccgaccctatttggtattctttttaattgtgctgaaagtcgtctttgctaaacttgcgttatcaaacacggaaaaatcagcgaacccatttttaaacgtattgcaattgttgcttgctctcgctataggcagcatcaataattccgccaccgatgcactcttcaccatcgtaaagcacgagggcttggcctggcgtaattgcccgagcaggctcgtcaaaatcaacggtaaccttcgagaaatcgtcactgaaatgcaccgtcactggaacgtccttagcacgataacggaacttagccgtgcacctgaagtcatggccgcgctcttcgcccagccggtttacaaaatgcatgtcggaagcgtccaagctagcggcgtaaaggtgcggattatcaaatccttgaccaacgtacaggatattcttggaaaggtccttaccaaccacgaaccaaggctcgttgttcttagaaccgcccccaattccgagtccgcgacgctgaccgatggtgtagtacatcaatccagcgtgctcgcccttaacttcgccatcaagggtcatcatcttaccaggctttgcaggaaggtagttgcttaagaactcacggaagtttttctcaccaataaagcagattcccaccgaatccttcttatcgtaaactgccaaaccagcttccttagcaattgcgcggacctctggcttaaccatgccccccaatgggaacataacccggtcaagctgttctgcactaagttggctcaagaagtaggtttgatccttattactgtccgtagcgcgcaaaaggtgctgatgaccattttcgtcgcgctccacttgtgcgtagtgccccgttgccacgtaatcagctcctaaactaattgcgtagtctaggaaagccttaaacttaatctcgttattgcaaatcacgtcgggattaggcgtccggcccttcttgtactcgtctaagaagtaggtaaagacccgatcccagtattccttctcaaagttaacggaataataaggaatcccaatcttagcggctaccttagccacgtccttgtaatcctcggtagcagtacagtatccattttcgtcagtgtcgtcccaatttttcatgaacaccccaacgacgtcgtagccctgcttcttaagcaaataggctactacggatgagtcgacaccgccgctcatcccgactacaacacgcgtcttgctgttgtctgtcattatatatcaccatcatttctagagattctggagaatcttacgattgaaggtcgcaataaatccagtaaattacattctataacaatcaattcggaaattccaccgttaacaaaaagttagtaaaaattattcttgcacgaggacttcccgttccaatagttggtcaataatgaaatggtattgctccactaagggttggtcctgttcgcgcttaaagatgtttgctttttgcattccgttagcggtcaccgtactcattttaaatgctgaaaaatcaggtttaatcattatttttaacttaatgccctggttgtacggcgaagtagcgtccaacgaccgttccaaaataaaggttccgttgtttttagtagtgaatcctaagtcagttaacgtataacgcttcaagttttcgctaagccggtaaacgcgggggtctccggcaatggtaacttctttagtaaatgccatgcctacatctccttacttttgttttaggtgctttaaacgctcctcaatgacaataatctgctcacacaagtagtctacatcttccgtggtggtgtttttaccaaagctaatccggattgattccccgatgcgtggtgaatcagctccgtacatcgccgtgagtacgtgggaaggttccaaactccccgccgtgcaagctgaaccgccggaaattgcaactccggccaaatccaaattagtttgcatcacgtaggtagacatccccttcaaccagatgttgaagacgtgttgtaaattatctggcgaaagtgagccattaattgcaaaatcaacgtcgtggtctttaagctgctgaataatttgttgcttaaaaccggcgtagcgtttttgtaaatctgctttagtctgctcatccagcaaacttaccgctttagcaaaccccgcaagattagcaacgttttccgtaccagcacgacgcttatcttcttgttcacccccgcggacaaaactatcaaagttaactgcttcatttttgtacagaaaaccagtcattttgggtccgttgagcttgtgtgccgaagtggacaagaggtcgatatgatcccgcttcacgtcaatatctaacaacccgtaagcttgaactgcatcggtatggaaagccgcctgatgatcctttaaaatttcaccaatttcatggattggcatccggcttcccacttcgttgttccccgtcataatgctaactaagatggtttggtcgttaagagcttccttaaactggtctaagctaattaccccgtcttcgttaacgtctaaataaactacatcaaagcccatttcctctaaatgagccatcggttttagtaccgacggatgttcaattttagtggtaatgacccgcttaccaagcttacggttacgtaaagccacctgcgtaatggcggtattattactttcggttccgccactggtaaaaattatttcatcatcgtttgcattaatactttgggcgattacgtgacgcgcttcgtccaactgggcccgcgcttgccgaccaaagccatgtaaactggaggcattgccccagttattcttgagttggtcagcaataacatccactacttcaggagcagtcggtgtagtcgccgcgttatctaaatatacttgtttcacgcttgcttcccttccatcttaaataaatcaattagcatgttggcagaacgttttcctgcctcaatgataaattcatcaaaggatactccagcttcgtcatcccccgtgtcagacattgcccggactacgataaacggcttatggaactggtgggcaacttgtccgatggctgccccttccatttcacaacataacgcatcagggaaatggcctaaaattgcttggaccttttcttgactcgcaataaattggtctcccgtgacgattaatccagttttcacgtttaagttagtatcctgagctgcttgtttaaacttttctattaacgctgaatccgctgcataacgggcaacatcttgttctggtaattgaccgtaagcgtacccaaacgcagttgcgtccacgtcatgataggcaacttctgcagacaacaccacgtcgcctaccgcaagtccctgtccaattccaccagcagaaccggaatgaattaacgcatcgactttaaaattagtaatcaaaattgcagcagtaattccggcttcaactttgccaattccagagcggactagcacaacttcgacatcttcaatacggccttcgtaaaaaatgaccccgttaatatccgtttgtttagttagctcaagattttccttaagcgccttaatttcttcttccattgcgcaaattacgccatacttcatcttcttttccacctatcctataaaaaataaaacgagaaatactaatacaattcccaccgctaaaagtgcaattgcaatgttgagtttctttgctaaagcgcgacttttttcttcagcaatctcgtcggtactaaaccgctgttcgcgactcgtccgtaaccgtgattcatttttagaatcttcatttgcagaagtttcctccggcgccttttgtgcgtgaatttttttctggtattccgcacgggtttgattcttttcgtccaaaaaatcacctactttgtggtcgcctgccaatggtaaattgcaagcaccgtttttgcatcttcaattttaccgtcttcgattgcttttagcgcttcggatagtgaaagttcaaaaacttttaagttttcaccttggtcccgcggtaatttatcttccaccggttttaaatcagttgccttataaaccgtcatgtattcgtccgtaaagcctggcgcggaataaaagccgaccattttttcgatctttccggcagcgtagcccgtttcttcgtttaattctcgcttagcggtttctaaaaaatcttcacctggttccactttgccagcggggatttcaatcgttggtttagcaactggtgcccgccattgtttttcaaaaagggctttgccgtctgcagtcagcgccaagattgcaattgcgtcctggtgtttgactacgtctcgattagccaacgtgccatccggtaactctaccgtttgttggtaaacgtcaacaatttctcccttataccgggaaactgacttaactactttttcttctaaatccattaatcctgttctcccttacgaaatacttttacagccaccaatcctttgggaccctcagccaccattaactggacgacctcgttttcatctaaagttttaaaatcatcggattgtaccgcactataatgtacaaaagccttttccccgttgtcaagctcgatgaagccgtaacctttggttttatcaaagctcgttaccgtaccagtttccaaattgcccactccttttattatttaataccatcataatcgtgagaactacttctgtaaattaaaaaagagactgaatttttcagcctctaattttagagcgttagttacgggcaaattttttcaaatatacccgcccttttaaatctaacggcgtcctatttttcttcaaaaccttcggtaactgcttccggatagtactttgtaacgattgccgcacagctagcacataaggttggaaagtgttcgtcactaccaacatccgtcttcgtcattcggcaccgttcgcaaacttctccgtcagcaggtgtgatttgaaccgcaacttgaccgtcaaaacctgccgcatcttcaggagcttctgcgaggtcccgaacttctaattgcgaaacaatcaagatcaaccgcaagtcgacgtttaattcgtcaacaacttgcttagtagcttcgtcaaggtacaaggttgcctttgcttccattgatttaccaatcatcttttggtcccgtgcttcttcaagagcctttaagacgtgagaccgtaacttcttgacggtttgccacttagccaacaggtctgctgccccggctaattcttgcacttctggcatttcagcaagctggacaaattcttccggttcagagaggaactgccaaatttcttccgtagtgtgtggtagaactggcgtcattaacttcgtcaaaccgactaaaatttggtagaagacggtttgcattgaccggcgtttcaaactatcttccggttcaatataaacgacgtccttcgcaaagtcgaggtagaacgcggaaagatccgtaatgatgtagttcatcaacgccttgtaaatttcaatgaaattatattggtcgtaatcttgccgaatttccttaactaattcgttaaaccggactaacatgtaacgatcttctggttgcaagtcagcgtaagctacggtattagcttgaggatcaaagtccgccgtgtttgctaataggtaacggattgtattccggatcttcttgtaagaatctgaaatctttacaaagttatcttgcgaaacccgcacgtcagacgatgaatcaatggaaagtacccataaccgaatgatttcagcacccatcttcttaatgatgtctgctggcacaattgtgttacctaaggacttactcatcttatggccctgtccgtcaagggtaaagccttgcgaaatcacctgcttgtatggtgcgtgacccgacatcgctacactagtaatcaaactagagttgaaccaaccgcggtattggtcagaaccttccaaagtcaggtcagccggatacttcaagtaatcgcgttttgccaaaaccccttgatgtgaagaaccggagtcgaaccaaacgtccataatatcggtttccttggtaaacgttccgtttggtgaatgttcgctagtgtagccttctggtagcaagtccttagcatcccattcaaaccagatatcagaaccatgtttttcaaatagttccgcaacgtgttcaatcgtttccccattcatgattggcgtaccgtcttcagcgtagaagattggtagtggcacaccccaaacccgttgacgagagattacccagtcgccacggtcccggatcatgttgtggagtcgtttttgaccccattctgggaggaacttaacgtcttttaacgcgtccaagatttgatcacgaattttgtctaccgaagcaaaccattgtggagtagcccggaaaataattggcttcttagtccgccaatcaaacggataactatgtgtgtaatccatctgcttaagcaaagcgttagttgcctttaacttgttcaaggcaatttcattagcatcttcgtagaagaccccttcaaaatcaggacccgcttcagcagtgaggtaaccacgatcatcgactggtacaaaaatatcgaggccgtattctttaccaacccggaaatcgtcttccccaaagccaggtgccgtatgaactaatcccgttccggaatctaaggttacgaagtcccctaacataaccactagcttgcgatcactatcaaatgggtggagcgccgtaatgttttctaactcctgcccgcgaaccgtcttgatggtttcaacgtcttgccacccaaattgttcagcagcgtaactcaaccggtccgtggcaatcacaaatttgcagtcgtcacccgcgggtttcacaacggaataatcaaaaccagcatcaatggtaattccttctgaagccggaatggtccatggagtcgttgtccaaactacgaagtaagtgtcttgatccaagacgcccttcccatcgcttactcgttccgcataaaaagcagatggcgaagtaacgtcgtgatactcaacttccgcttctgccattgccgattcggaagaccatgaccaaaatacgggctttttaccacggtaaatcaagcctaactcaaccattttagcaaaagtccgaatttcttctgcttcaaaagatggttgcaaagttaagtatgggttatcccattcggcagctactcccaaacgcttgaagtcttcgcgttgcttgtcaacttgttttaaggcgtaatcgcgacataatttacggaattcagccgtcgacatttttttacggtcgtggccttccttagttaattgttgttcaatcggtaaaccatgcgtatcccatcccggaacgtatgggctccgaaaaccactcattgatttatatcggacgataatatccttagaaatcttgttcatcgcgtgacccatgtgaatgtttccgttggcatatggcggtccgtcatgaagaacaaaacttggcttgccctcatttaatttttgtcgttgttcataaactttgttttcaaaccaaacgtcttcgcgcttcttttcgtttaccggaagatttccgcgcattttaaacttggtttttcctagatttaaagtatctttaacccgcactaaaatcactcgctttcctaagtattattcttgaaattttagacaataaaaaagactccatccctactagggacgaagtcaaatcgtggtaccacccaaattcaaggacgttaaaaacgtcctcctcattttcccataacggtggaaaccgacagcgtctactaaatacttcaacgctgcactcaaaagtgattgtccttctaactagcagactaacctcacaccaacgttagctcgctgaactgctgattgctagaagtccctctttttttacgttttattttttaggatttacgtggaacccttggtcagtgggtttcccctgttcgttaggttgatcttctggaaagaccaccaccgtttttagctcatcttctttgggctctacagcaggtgtgtccggatcaattttcccaacttcttctgagtgtacactgttttcctgaatgatgtcaagcgctccgctattccgcattgcttccttgatttcaccaatcgttagcaattcatcagaactcaataagttatcccaatcgcgtcccttgatcatttgtaattgtgattcaagaagtacttccagcttttgccggaaactacgggcttgtttcttcaagtcgtcagttgccacaataaccttttgagctttgccagcagcttcgccgatatagccgtccgcttttttgtgcgcatttttgactactacttcagcttctttttgagcttctttagcagtgaattccgcttcccgtttagaactaattttaaccttatccgcggcatcttgggctaccataatcgacttgttcaaggattccttcatctcgtcgaaatattccacccggctcttggcttcggctaattggcgccgtaacgaatcaatttcatcatgcaaacgccgttgttcaaaagcaacgtcatctaaaaattcgtcaacttcgtcggggttatacccgcgcattttgttggaaaagtgtttttgttgtatatcttgtggttcaattgccatctgaataaaacctccgtaaatcgctacctagttttaattaaatctagttgggtttttagcttatctttttttgttttacctaaaacttccacaagcttaatcctaccatattttcgaactgaaatgacatcatttctcgcaattattgtgtctgctttttcatcaatcatccagtttaattggacttggcggtgctcaatcaactccttggcacggtgacgagagatcgaaaaggcggtggccactatcgaatccagtcgtaacgacgcaagcgtcacttgcgttctttcccaatcattaaccggtgtaagaatctcggatggggctgccagctgcatccgtactttaatccggccaattcgcgtaatctcatttgaaaagaacttctctaattcaccgttcgtggccacttgccaacggtcttggtaatgaacaatatcgccaaacgtatcccgttgaatcccagaattcgctaacgtgcctaaaatctggcgatgtttcaattctgcgaatttaaccggataatcaatttcaaatattttaactagaaaatccgctttttccggaacaaagtattgggggtaaatcaagccccgctggttttctgcattggtaaatccaccaaaaaaggacaattgtaattcttcatcccggttaaccagcgtcgttaaaatgtgttgctgccttggatttaaaaagttggttaaaatggaccggttttgatccttggcttcttgcaccagcgcactgaattcttcaattaacggctgttcatccggacggaagtgctgaccaatcggattatccataaaccgtcacaccaaatagcagtgcttcaatgtaggtaagcccgttagaacacaattctaatactaacagagccagaattggcgaaaaatctattcccaaaattggtgggataaatctaaaccagctcatgtatggctgacaaattttagtcaaccactggccaaatgcagattgataggcacctggaagccaggacatcaatacccaaataaaaatcagcatcatgtaaatttggattgcccagtgtagtaattgaaaaattaacgcaatcattatttttaatcactcatttcttgtcattatgcaataaatgggcttgagccctgctcaaacccatttaaatacaaattattttctacgacgtttgaaaaatggaggtgtatccaatgattcatcgtcagaacttgtattgttattatcgttaaacgcgttaaactctttcttttccacgttcttaaattcattatcacttggcgatgaagggcgaacggtagaagagttatttgattgccgaagttgccaatcaccaaatggatcgtttgcagcttgtgtattttggttattcgctgctccattattattaaggttatcagtcgaaccagccccgcgcatttcagtgtttgctgaaatgttgtttgtattcgcagtgtttacactacttgggttctcaaaagaggtgcgtgctggttgacggtgtaaagacgctctaccagcttttttatcaatcccagtagcgataaccgttacccgaacgccatcctttaactcttcgtcgatggaagtaccaaagatgatgttaacgtcatcgttagccgcttctgtaacgatttgtgaagctgcttgagcttcgaacaaggaaaggtctgggccaccagtgatgttaagcaagacttgttcagcaccatcaattgatgtttccaacaatggtgaagagattgccttcttggttgcttcttcggtccggttttcgccatttgcggaaccaattcccatcaaagcggaaccttggttttgcataactgtcttaacgtcagcaaagtccaagttaacgtaacctggtgacgtaatcaaatcagaaataccttgcacaccttgacgcaaaacgttatcggcttcgttgaaggcttccatcattggcgtcttcttgtcaactaagtcaagcaagcggttatttgcaataataattaaagtatctacgtgttctttaaggttgcttaccccttcagcagcaaaacgcgcacgttttgggccttcgaaagtaaatggacgggtaactacccccacggtaagggcaccttgttctttagcaattttggctaccattggtgcagcgccggtaccagtaccgccacccattccggcagtaacgaaaatcatatctgcgccttctaaagctgaagcaattgtttgttgactttcttcagcagctttagcaccaacttcaggagttgatccagcacctagtcccttagttaatttcggtcctagttgaatctttacgtccgcatttgacgcttgtaaagcttgcacgtcggtgttagcaacgatgaattgtacccctttgactccttcagaaatcatccggtttacggcgttaccaccaccgccaccaacaccaataactttgatgttagcgcctttactcttgttatcatccattgaaaattccatgtttaattcctccatcgttaatgttagtcaaagaaatcactaaaccattttttgattccatcgaagcgattggatgtcgcttttggtgatgaattacgttcaaccggcttagagcgttcttgcgttggttcagggtgctttaccgttgcttgagcacgtttaaatttaggtttctcatccactacttcttcttgtggcgtctctgaaactgtccgttcacttgaaaccatcgcatttttcgctaagatatcaacgtcgctcatccgtccttcgtaatttaggatagctagcgcctgcgcaaaggcggggtgtctcaatcccatttggtcaggaacgtataatttagcgttagtttcgaaaattctttcaactaacttttcgattccaggaagggctgcccctccaccggtaatcacgattccacctggcatgtccagtgcaccaattttatctaattgcttcttgatattagttaaaatctgttccaaacgtgcttcaataatctcactcaagaactcttcatcaaccgcaaccggctcgttttggccaaccacgttaaccgggaaggtttccttaccggcttcgctagcaaccgcgtaaccgtattgttgtttaatttgttccgcgttatctaaagaggtgtttaataccactgagatatccttggttacaaattggccaccctcttgttcgacaaaagtgtacttgaggtggtggtcatgaatcactgccaccgtcgactggcctgcgcctaagtctaacgtaattgtaccaaaatcttgttcaccatcatttaagattgttttacccagtgctagtggattaactacaacgtccaccaagttcaatcccgcttgacgaaccgcactcttcaaattatggatgattgttttaggtccggtaatcaatccgccgttcatttccaggcgaacccctaccatccctcttggatccttgataccgtcgaaaccgtccacaataaactcatccggaagcacatctaccacttcttgttccggaggtaaattatgtacagacgccgcattagaaacttcaatcacatcttgattattaatctcgcgtgaactatctgagatagcgatcattccccgtacgggttcgattcttaataaattagctggaataccagccactacatcttggatttgaatatttgctttgcgctctgcagtttcaatagcccgattaatggcaatcgctgccttatcaatatcaacgattacaccacgattgactccatctgagggctctcttcccacaccaataacgttcatttgtcctttgacatattcagcaacaataacttttattgaggtggttccaatatccagtccaacgtaaattcctgaattatccataataaaggaacctcctagtcgtttaactgtttcatttatatacttatcacatatattaattagtttaccatattcattctttatttagaacgcagaatcccactaaaattacagcttatttcaactaattgccggtcaaaatggttcttagtcctcttagtttccatctgggttctcttcatcagtcgctgtaaaaccttgcacactatattgcgtagcccgtcgttgttgggtttggtagtcaacgttgtcaattgaagaactacttgatgaatctgctgatttactcttcgcggaggattcagcacttagtgaatttttttcgctaccggacgattgacttccctcttccgtcgggtcagtcgaagtcgaactagttgacgattcatcactttgcccccgcggatacgagtatgcaccgacttgtaggtccacaattcccctttttttcatgcttgctgaaatttccgggtagtacttcattttcttagcaaaggtatttaaaaccgcatatacttcattaccgtcattcataaagaagtgcaactggtgtcgttcttttttggttgccgtatagtcaacttctgcaacgtcgttttgcacttcattaggtaacttcgcgtattcgcttaggaaacgtttcaaaacctgattatctttaaactggcggaaaaccgggtaatcaccatctggttgggtagcactttttttagataccgtgccgtcttgtcgaactgcgtagtagtatttgttgcgcaccacgtatcccattacggcgttttcacgcactttaattttgacgttacctaataacgagaccgagatttgagcatcctttaaatccggtagcttgtgaattagacgcgcttcgtcgccccgttccttaaaccaggtcgccggaatcacgtcatttttccttacggttactttctttaaaatgtcacttttttccacccgtttattcccctgtacggcaatggtttgcacccggctaatgggggcgcagaggtagatcgtaaccaaaatcaagatcccaatcaagctaagcaaaccaattttaattcctttaccaatgtgtaaaggctggcggactttctttggggttaacttattacgctttttccccgggtgcttttttgcagtaccacgctttgcgccgcctaatttagaattctttttagtccggttacgttggttatgctctttttgataacgggcccacggggttagattttcatcatcttttttctttttcattggcatcacccgttaagctttgattactgatttcaaaacggcgtacaatttttctgctgcttgcggctgtcccaattttttagtattttcggccatctgcttacgtttttggtcatcgagcatcaaatcatccaacttagttaacagagtctttgaagttaactcattttccgtaatcatttctgcagcgtgttgatcgactaaactgcgcgcatttttagtctggtgatcatttgtgacgtacggacttggaattaaaattgacggaattcccagggaagtaagttcggctaagcttgttgctcccgcgcgacctaccacgactgccattcgaggaagcattgccggcatatcagcaatgtacggtaacaccgccactttccctttataaggagttaggtcaacgtccttagttaagttatcaaaatgaactcgcccggtcacgaaaatcgtttggtaattacgttttactaattcattcaaagattgcatggttacttcgttaattttttctgctccacggctaccgccaaaaattaacacggtgggcacgtcatcttttaagccaaattggtttagcgattgcggagtaattttaactacttcggttgctcgcggattcccggttaaaaccgctttttctttgggaaattggtctgctgctgcttcaaaggaaattgcaatcttcttaacaaacttacttaagaacttattggtgacccccaccacgctattttgttcgtggatcaccgttggaatccccatcatgctggcggcaaatactaccgccccgctgacgtatcctccagttcctagtacaacgtctggtttaaactccttaatcattttacgcgccttaaccacgctactcaaaaacagtcccactgttttaaagttttctaatgataatgaacgtttaaatccttgaattttaatcgttttaaaatcgatccccgcattgggaacaattttgttttccagtcccttatgcgttcccacatacagtactgctgaatcgggttcgacttcccgaacttgtttaataagggcaagtgctgggtaaatgtggccgccagttccgcctcctgaaaccatcagtctcatttagtgacatctcctttttccttcgataaattttctacggcggtgatgaattcatcgccccgttcttcaaaagtttggtattgatcccaacttgctgcagctggtgaaagtaaaattacgtctccaggttggctgtcttcaaaggcgatggcaaccgaattcttaacccgcgggctgtccttaacgactttaacgcccgccgtctgtgcagcttcctgcatgtgcgcagcagtttgcccgttaacaatcacttccttaacgtggggcttcaaatcagccaccagtcgggtgtagtcgtctccccggtctaaacctcccgcaatcaagatgattggccgttgaaaggcctttaaagccacctgcgttgcttcgatgtcggttgcttttgaatcattatagaattggcggccggctaaggtttttacgtattgaatccggtgtttcaccccgctaaaagtttggagaacctgcttaatatgtttattagcaaccccttcaattttagccacagcaattgccgcgagcgcattttcaacgttctggtccccaggcaccccgatttcatcggccgccatgatccgttcatttttgaaatataattgaccatccttggcgtaggccccgttttcaactaaaccttggcgggaaaacggaacgacctgcgccgcagtccgttgcgctaattgttgccattcaggattatcccagttaatgacaaaataatcatctttggtttggttctccgtgatcctcatcttgtcattaacgtaattttcccgagttttgtgccaatctaagtggttagagaaaatgttgttaaccacggcaatgtgggggtgcaactggtcaatcccggcgagcataaagctagatagctccattacgacccggtcgttagcagtagctttttgcactaccgtagtcgcaggaaccccaatatttcccgccacgtatgctgcatgatgatcttgctgatctagcattagttgaatcatcgtggtaacggttgtttttccgttactaccggtcaccccaattaattcgctgtccatcacccggtatgccaactcaggttcggcaatgattggcacgttttgctccttagcagctaccaaaactgggtttgcatacgggattccgggattcttgacgattaattcaatatgatgctgagccaagattccctttggatgactgcctaaaatcatttggacgtcagcctttttaagttgttcaatcagttcttgcggttgttctgcttttgcgtcatttactaatacctgcgcattcagtttacgcaacaaaagagcggcactaactccgctctttgccatccccaaaacgagaatattcttatttgctaaatcctttatctctgctaatgctttcattctataatctccctaccaaatgctaattaacgtaattagcgcaccgatcaatccaacaatccaaaagacggtgtcgactttccattcactccaacctaacatttcaaaatgatggtgaatgggactcatcttaaaaattcggcgtccggttagcttaaaggacagcacttgtaaaattacgctgagggtttccaatacgaatacgattcccaccagtagtagtgacaattcttgattcaaaatgatggaaaccgcccctaaggcgccgcccaatgctaaggaacccatgtctcccataaagaccttggctggtttgtggttaaatacgagaaaggctaacattgcgccaaccaccgcccagcaaaatagcatcactgcaggttgattgagcttcgcagcaataattgcgtaagtagcaaacgcaatcgtcgataaaccagcaactagaccatccagtccgtccgaaaggttgactgcattggaaaagccaactaaccagaaaattacaaatagtgcgtaccaaccgccaagatgccaaattccgattccggggattgataattgcaaggctacgccagtttctttaatgacccagtaaaaaatcaatccgccaatgatttggccaagcagcttttgccaagctttaaaaccttcgttttgccgctttaataatttaatactgtcatcccagcaaccaatcaaaccgaattctaaaagaacgaagaggagcatcactaggttggtggtcaataaatggaacgccaacccgctgatgatcgcagccacgataatggccacgatgaaaactagccctcccatcgtgggtgtcccagatttcttttgatgccacttggggccttcttctcggatcatttgcccttcgttccgtgcccggaaataatggataaaactgggcatccctattaaagtaattacggcacttaagccgcccgctaacaagttactcatttttcttctcctatgctattttttgagtgttaccgtcatggtcattcctgattgaaacgtagttcctttggcgactgactgaccggctacaaaacctttaccttggtacttaacttcaatgttaaacattttagcaagtttaatcacgtcgtttttggaccatcccgtaaggtccggcatggtaaccgttcctccggtattcaaaagaatccgctggcccactaacaacttactaccggccgattccgattgtgccaaaatccggctcccattacctaaccgaaccacagctacgttatttttacccaattccttcaccgcgtcgtcagcatctttacccaccacgtttggtacttcaatggaactatcaatgtccgtattcgcagtggatttatcttgttcaagggcctgcttcatcactggcccaaaaatttcatctagtaactgggttgccgtcttatccgcaggcaagtttggttttttcatcgtaatgtacatgatgtacttcggattttttgcaggagccatcgcggctaccgaatacaggtagctgtcgtcaccagaagcgtagttcccgttacttgcaacttgcgccgtaccggtttttgccgcaatccggtaacccttcagcttaaagtcgctcccgattccgtatggtttataaaccacatcttgcatcagcttacggacttctttagtagttttagctttcactggccggcccacttttttggttttcatttggtaggtcgtttttcccgtgttggggttcaccacttttttaacaaactgtggcttcaccatttgtccattattagcaatcgcggtgaaaccttgcaacatttgcatggccgtcacgttaattgcttgcccaaaggcggtgtccgcttgctcaattggatagtcaaactgcatactgccctcggattcgccttctaaaccagagttagttgattctagtaggtggaatcgtttaatatacttcttccaagttttggcacccatcttttgttccaaatgggccattgccacgttactagaaagggcaaatcccttttcataggaaattaatccccagccttcccgcttccaatcgggcactacctgtccatcgatttcgtaggtacccgacttatacaactcatctgggtcaaaattaccactatcaattgcagcagcggtggtgaaaatcttcatggttgagcccggttcataagtatcctgtactaagccgttattccaagctttggacaagcctttcttagtggaggcgttaaacgttggacgttgggtagttgctaaaattgccccggtcttagcgttcatgatagttgccccaatcgactcaggatgtgcctgagactgtactttgctgaccgtgctttccatgatggtttgtaaccgttgatccaaggtggtgtagaccgtgcttccatcccgcgctggacgttccacctgtgatcccggcaattggtaaccaaacttatccttttgtaaggatttttccccatcggttcccgtcaactgcttgttcaacatcttttcgagccccataactcctgaaagttgcgtggtatcgctccccttttcttgagactgttgggcaaagccgattaagtttgaggcgaaaaccccgttaggatataagcgcgcttcggaggaaacgaagttaatcccggttaatttgtatttttcaattttttccttagttgctacggaaatgttatttcccgcactcccaaattccacttggaaagtcttgggattattaggactcaaagtttttaacgcttttttgtagctaattggtagatacttgctcaatacacgcgccgttttctttttatcggttacgtacagcggttggcgatttgggcccacctgctttttacttaccaccgcgtaaatcgaatatgtactagtatcctcggcaatcgggttcccgttggtatctaaaatggaacctcgtttagccttaatagttttattgtccgtgtatagccgtttggcttgactgctgagattgacgctttcaatcgtcttattaatggcaatataagaaaagcgcccaacaatcactataaatactcctgctacaatcaataaaaaccattttccaaacatcatccgattgtgctgagtttccgtagtattagtcgttcgcttttttgggttcatcatttatttacattccttatattctctgaattaagagaaaggcctgcctttttagcaactttatttagccgattttggtcggataactgattaacctcttgtttcatagttgtatttttgcttgataaggccgttgtcttctcttgtgttgcttcaagtttatgctgtgcattagataaacttattttaccagaaacaacggtaagcattaaccctaccaaaataaatccgcaaaatgttatcaaaaacttttcaaacttcgacaagggcagttgtcgagcagttacaacctcccgggctttttttaattcttttttccctactccggcaattgaagttggttcgttaatcattcttgaacgaccagcataatcattattttgagccattggcgtctacctttcctgtaacttttcgataattcttaattttgcactatgtgctcgacgattttcctttagttcgtcctcagaaggaacgattggtttacgattaaccaatttaaaatgcggttttttatcagctggaataactggtagtccagccggtaaatcaccaatttctgtcttttctttaaacatgcgttttactaagcgatcttccagcgattggaacgtaatcactgaaatccggccgttgtcgtttaacaaatctaaggcttgttccaatgattcttctaaagcccctaactcatcattgaccgcaattcgaattgcttgaaacacccgtttagcggggtgaccgcccgtacggcgcgctgccgccggaattgcttctttaataatctcgactagttccccggtagttacaatggggtgttgctcgcggactttttctattcgccgtgcaacttgctttgcatacttttcttctccataacggaagaaaatccgaaccaaatcgttgtacgaccattcgttaactaccgtttgggccgttaattcttgactctggtccatgcgcatatcaagcggtgcgtcatagcgatagctgaagcctcgctgggcatcgtcgaattgcggtgaggaaacccctaagtcgtataggatcccatcaacgtgatcaattcctcgttggtttaattcattttttaagtttctaaaattagccttaataaaggttacttgctgatttgctatgtatggtgccaaatgatcttgattgtaatcaatcgctgtttgatcttggtcaaacgaatacaaatgacctgtagagcccagcttagataaaatcaactgactgtggccgcccccgccaagggtacaatccacataaacgccgtctttgcggatattcaatccagcaacggtttcttccaatagcacggtggtatgtttaaattctgtcatttatatcacaatccaaaatcaattaaattttcggcaatatcgtcaaagttcgcttcagtttcttcgatagcagcttcccagcgggccttattccaaatttcaattcggttagaaacccctactaaaacacattctttttgcaaatctgcgtggacccgcaactttttaggaatgataattcttccctgcttatcaaagttacattgggctgcatcagcaaacataaaacgaacaaacgcccgattatttttcttattagatggtagttgactaagcttttcttcgacgagtttccattcactcaaaggatagccaaataagcatccatctagccctcgcgtaattacgaaatcctcgcctagttgatcgcggaatttagatggtatgatcaaacgtcccttgttgtccaatgaatgttcgaattcacccatgaacatgaaaccgcctccgtcaactaaatctataacaatattaccacttccccccactttccaccacttaattacaaatgttttttcccaattttttattaaatttaaacattctgtaaaagcttgatacgaatagggttttcacttgttttacgaggtggagaaaaggtgggggattcatccctggatttgcctaaaaaaattacttattgtagaattgctgtaaatcatgagaaagtagtgtttttaaatgtataataataaaaagaagaaaaagagcggtctgcaaaaggtcatcatggtctttgtttggattatgattatcttgaccctgggcagcgtactttacgccccccttgcccaactcctgggtgcttaaacatctagatataaaagagatgagcgtgggacaaaagtcgggtagtttgcgagcattaactgaaaattgaccatgatgcctgaattgggcatgatgatcaattttttggttaagcggaaccaactgcttttggcacacgttttggctctattgaagtcaaaatgccaaaataaaaacggttcatgaggaagtttcacctcatgaaccgtttttttgtttagagacttttggcacagtcccgtctttttgaaattgtcctcaaaacactaaggacacctattgctcatctttagtacggtaaactttacgcggcttactaccttcttgcggaccgatcaccccgttttcctcaagctggtcaatgatccgcgcagcccggttgtaaccgattcgaaacttccgttgcaacatagacgtgcttgctcgttgcatttccgttactaactcaacggcttccggataatattcatccaattcgtcagtagcttcagtttcggcaacttcttgatccgtaacgtttagttgatcatcgtattctgcagtttgttgctgcttaacaaaatcaacgatttccttaacgtcgtgatccgagatgaatgctccttgaacccgctctggcttgttcttgcccattgggaaaaataacatatctcctcggccaaggagcttttcagcaccgttagcatcaataatggttcgtgaatcggttcccgaggctacggcaaacgcaattcgggaaggtacgttagccttaatcaatcccgttaccacgtcaaccgaaggccgctgggtagcgataatcatgtgaattccagcagcccgcgctagttgagctaaccgaataatcgcatcttccacttcgttagaagccaccatcatcaagtccgctaactcatccacaattacaacaatgtacggcatttttggccgttttccaccgtccgctgcattttgttcctcaatgaattcgttgtaacttttaatattacgctgattcatttccgcaaacaaatcatagcggtgctgcatttctgcaaccactttatgtaatgctttagcagcctttcgcgcatcggtaactaccggagttaataagtgaggaatgtcgttgtaaattcccaactcaacctttttaggatcaattaaaatcaacttaacctcgtcaggtcgggcattcattagcaacccggtaataattacgttaatcattaccgacttccctgaaccagttgccccggcaattaacaaatgttgcatcttaactaagttagcttcaactaggttacccgaaacgtcacgcccaatgggtacttttaacggatcatctgggtgcgctggttgggattcaatgatatcacggaacgaaaccgttgatatcgtccggttagggacttcaattccaaccaatgattttcctggaatgggtgcttcaattcgaatatccttagcagccaaagccaaggctaagtcgtccgccaaaccaacgattttgctaaccttcaccccaattgccggatgaatttcatattcggtgactgatggccccattttcacgctttctaccgaggcgtccaccccaaaactattcaaagtgtcctgtaaaatttgggtgttctttttgattgaatcgtattctgagctttggtcagcttgcggaatttcggttaacaaggttgaagatggcaaccgatagttaggattcaacttattctcgctttcaaatcccacttccgggttagcggttggttgcttttcctgattcttaggtttccgcggatttcgttggttattggttgaaatctcaatcttaggctccgcggggtgttcaataccacgagtcccatcgaccaccggttcttcagtagttggctctacgcgcgtcctttctgacttaacggactgtttagtagcaccatcctccggcggcttcctctccatgggggttcgtttaaaatccggtttgctaatcgtaaagtccagctgttcccaccagtccaaaacgccgcgggttaatgcccaaattccttcgattaaccgctgtgtaatccaaagaattgcgagacccgtctttgatagaacttcatcaaaaggaatgccaaagaggattactaagcccaccgtcatcaaaacaattgctaaaatggcgctgccaatctcactcaacaagaagtgcgtgccgctatagaagaccgcccctagcaaaccgcctccaatatcgttagtggtgatttgttctaaaaaggatcgttcgattccctcaacggtccgggcaacaaacccactttccaaatttagtccgcttgcaaaccggtactcgacccaaagcaaataaccaatcatggttaagctaagcccgattacccggtcgctagcgcctttaaaccgtagttcccgtcccataaatagcaggtagagcccgtaaaaaaatagcaatacaaaccccagcgggcttaggctccccacaaaaatccgaaacatattggcaaccagcattcctaagaatccccggccaaaataacctaaaagggcaaccagtacgtacgccagccccaataaattttgggtagggaggctttgttgcttctttcgtttgcgcgttgttttacgccttttctttgcttttgccatatttaaccctatttcaatttatcattttcgtattcatgactaatttctaagttaggaaactcctgttgtcgtaaaacttcgtatatcacaattgctaccgaattcgataggttcaatgcccgaatatgttggtcattttgcggaatacggattgcacaatccgcatattggcgcataaaggcttccggtagtccagtcgtttccttcccgaaaagaaagtagttatccacgtcgtcttcagctccagtataatcagcttgagtataagcttttgaagcaaatttagaaaccacaaaaagtcgttttcgatccttaacggtcgctaaaaaatcaggtaagttatcgtggtaaaccaccttaacactgtcccaataatctaagccggcccgttttaaagtcttatcactgatttcaaaacccagtggcttaattaaatgtaataccgcgttagttcccgcacaagttcgggcaatatttccggtattagccggcattaacggctcaaataatacaatatgatttgtcatttttaatctccatttagtcttaaaattaaaaacgtagacactcggtattgcgcggcgagtatctacgttcgtgaagtccccgaatcgtttcaaacgaaatcccttcgatatccgcgtaacacgggctccatccgcatactaacactacttttttcattctgcaaattagctattgttcgtaaccgcctacccgacgcttgaaaagctcaaaaccgtggataaacagtacctttaacactgcataagcaggaatcccaaaaatcacaccaaccaaaccaaacatttgtcccgacgctagtaaaaccaccaaaatagttaccggatgaatcgctaggttgcttcctaaaactaatggtgaaatgaaacggccttctaacgtttgttcaattgcaaaaacaatcagcaccttgaccaacatcactggcgagatgaacgcgccaattactatggaaggaaccattgctaaaaacgaccccaagtaaggaattaaatttaaaaatcctgccgcaaccgcgagggtaagtgcaaattttagcccaattactaagtaaccaataaaaaacatcagggccacgaagaatgcgaccactaattgtccccggatatactgacttaattgggtattaatttcaccaaggatctggagaaattggggtcgataccgtacgggaaaagccttcgctaggtattctggaaggtcatgtccatcccgcaataagtaaaacaggataaacggcatggtgatgatgccaatcaccaccttcgtaattaagctcaatacgcttcccaacgaagtgaccgtattattggcaacgctcgttactttctttgaccacgattgaatggtttcgctactaactccgtggaattgcttttgaaaatcacctaagcgtgggtcatttaagataccattgattttttctatagcagcgttccaataatctggccagttttgaattagcgctgcagtttgttcccgaatcacgggaatcaccgccactactccagcaacgatcaagatagccaccccgacaaaaataatactgatggaaaccacccgtttcattttaaagcgactttctaaccgatcaaccaacggattcaacaagtaatacaaaacgctcgctaaaataatgggaaatcccacaattttaaagaagtcttccaacggcttgaaaatccaggtaacttttgaaaacataaataaaattagtaacactaataacacgatgatcaaactaacgaccggccggttattgagtactaactggttaaaccacgttctccacctaggtactttaggcttgcgttccatcaactttcaccgtccaatcacttgtattgaatagtttcccccactttaaagtcgggaaaaacatccgggctaaggtaaattgcgctcgccaacggctgttcaggtacctctttaaaaaccagcgtcgtgtgaccaatgctttgcaaattttgatttaccaaactaccaacaaatttaacgttataggtttgttcaccaattacgatttgtgaacccgcttttaaattaaattgctgatcattatctttttcaatttcttggacaaccgcaattttctttaaatctggcgttgcggtttcgtcaaacaaaattgctaaccgatcttgcttagcaattgcctctggtccaatactttttaccttagctgaaatcatttaacacaccccttactcattatgattttattgtaccatagtggggttctcacaccttcagaaaacgtattcaatccgtgaaatatgctatacttaacggtgagttttacctagagaggagcacaagtgctatgattgaaaccattttattaggtacctacaccaaacaaaccagtgaaggaatctatcaagttgaacttgatacaacccaaaaacaactccaaaacttacaattagttgccaaagtagaaaacccaacctatctaacggtaagtcaacagcaaatgctgtatgctgtcgatcgttaccaagatcaaggaggtgtttcggtaactcaactaggcgaccgttctcaagttttacaacatttagtacagccgggaaccccgcctgcttacgtaaccgtagacgaacaacgtcacctagtttttgacgctaattatcacgaaggcaccgttcatgcgtatcaaattcaagccgacggaacccttaatttagcacacacctttactaatcaaggctccggcccgcgtccagaacaaagtgaagcccatccccattacgttgatcgcactcccgatgagcaccttgtggtctgtgatttaggttgtgatgaagtatttattttagattatgatgcagccaccggcttccaaacggtttctaagtacgaaactgctccagggtttggcccgcggcacgttgtatttaaccaacaaggaaacacggcttatttagttggtgaattggcaagtgaagtagaagtgcttaattaccacaatggtgaatttcgtcacgttcaaacgctaaaaaccatccccgacgactgggagcaacataatggagccgccgcaattagaattactagcgacaaccgtttcgtttacgtatccaaccggggccatgattcaatcgccgtttttgcggttaatggcgatggcaccctcgaactaatccaaaattgtgccattgcaggtagcttcccccgtgattttgccctaaatgctgacgagcgttttcttgtttgtggcaaccagatcaccaataacttgagtttatttgaaagaaattccgagaatggtaaacttaaacttattcaaaaagactttgccgctccagaagtggtttgcgtctactttaaataaaaacgaggttaattatgcttaaagaagttccagtagaaaattacactgacattccccgggtaattgccaacggggctaatcgaattgagctttgtgacaacttagcggtgggcggcactaccgtcagtcacggggtaatggcggaaagccagaaatacgctagcgaacatcacattccggttatggctatgatccggccccggggcggcaactttgtttataacgatattgaattaaaaatgatggaagccgaccttttccaagcacaacagcttggcgttgacggtgcagttttcggtgcattgactccccaaggaaccattgacgaagaggcaatggaacaattaatcggcgctgccggtggtatgcaaatcaccttccacatggcttttgacgcgattccggttgagcaccaggccgctagtattgattggctgattgaccacgacgtggatcggatcttaacccatggtggtccgttaactaaacccattgaagatacgcttagccacctcaaggaaaccgttgaatacgctaagggccgcatcatcgtaatgccgggtggtggcgtcaccgttgataacgctgctgaaattgctgaacaacttcacgttcccgaactacacggctcgaaattagtttaatcctaaaataaaagcatcgtggtaattcccctgattcatggaattatcacgatgctttttatactattaattaacctgtcctagtgaaagttcgctaagcaaattgtcgcaatgttaaagtaaattaaaattgaaataatatcactaacggtggaaatcagtggtccgctagctacccctggatcttgacctaacttttccagaataatcggaattaaactacctaccaaattagcgataaaaatagctccccacatggctgccccaacaattatgccaagcattaagttgtgttgccaaagcaatactacgacgaaaatcactaaaccagtaagtacactagttaaaagtcccgttagaatttcatttaaaataattttaaatccactattatcatcttcatcatttgccaaccggcgcattgcgaccgccaaactttgagtacctgcgttaccagccgtcccggtaatcaaagtgatgaaaactgccagtacgccaaatcggtcaagaaccccttggaattggctaatcacgaccgcactgatcaatcccaagaataacatggttactaaccaaggcatccggctcttgaaagctgcccaaggattttccgacaggtcttccgtaccaaccccggccaaccgtgaataatcttgggcggactcttcgtcaattacgtcgatgatgtcgtcaacggtaatgattcccaacattttattgttcttatcgactaccggtatcgcaataaaattgtagtcccgaatttgagtggcaatctcaacttggtcttcgttatccaataccgacaccacgttggtattcataattcgtttaataaatacgtcgtcaggattaacaatcaagtccttaacggagattaccccaattagttggttagattcgtttactacgtaaatgtacgaaatagtttccgcatattgggcttcttgcttaacctggttcattgcggaaccaaccgtggcatcgaccgctaccgaaataaattcggtagtcatcaacgcccccgccgtcttatcttcgtattttagcagctgccgaacgcgagccgcatccacgggttgcatatacgatagtaacttatgcaacttatcattgcgaaccgcccccaatacgtcggcttcgttatcatcatacatcccgttcaacaacgctgccgcatatcgcggagtcatttcatctaagtattctgcaatcaaatccggctcatcatcgatttcgtcaaaggcgtctgccagttcatctgggctgaggtattgataaaccagttgccgttcgggaccggttaactccccaaaaaaacgcccttgatcataattatgtaagtcaaggaaatcttccttgaaactctttgcgtcttctttatttagttctaattttaatttatcaaaaatcgcttgagtattatccattattctttatccttttctttcttccaatattcaagcatgtcatttggaattggcgcttgtacgtcaattttctttcctctaaacacattctcaaacttcaatgaaaagcagtgcagcgcctgcctttgtaagttcctaaaggaagtttcgttataaagcggatccccaatcaacggatggtgaagttcactaaaatgaacccgaatctgatgggttcgcccagtgtgtaactgcactttcaacagggaatccgtagcagtctgctccagcacccaatattctgtttttgaaggtttcccattgccagcgctagccaccctgcgcttaataaaggaagctgggtccctttcaatcggggcgtcaattaatccgtgactttgtgcaaaccttcccgtcgccattgctaaataatatttttgcacccggtgttgtcgtaaatcttggtccataattgtatgtgcaaaccggtgtttggcaaacaaaactagccccgaagtatcttgatcgagtcgggtcaccacgtgaacaacctgactttcataatccctttccgcgtaataattcttaacgcggtttactagggtatccgtttgatttcgggcggactgcaccgttggcaaaaatggcggcttgtttaccactaaatagtcctggtcctcgtaaatcacatcaattggttgacgagaccgaaccacgtgagggttccctggctctggcggtaattcaacggttacttggtcaccagcagtcaccatcgcgttagttcgcttgggctgctcattaactaaaatttttccaccattaaacttaatactttttaatagtgctcgggaaatccgtttccgtgtcaaaaaagttcgtagatgttgaggggactcatcttgaacttgccaactaaatttcatctatttgaccaataaacgaattccgcacccggttccaaaaaccagtgtgccggtatttaagaaactttaccttaggaaccgcaattccataatgtacggattgcacgtttttgtctaagatacctagccgatctgccgtaaaattgtaagttcggtgataacttggtaaaggtcgaatcgtaacggtctcatttggcgctaaaattagcgcagcgcccaccgtccggaaaacccggttgttaatcgaagcaatctccgccatctgcattgcttctaactgcgggtgcacaattgctccgccaaccgaccggttatatgcggttgatccggtcggggtcgaaatacaaagtccatccccccggaaacgctcaaataattgatccccaattaaaacgtccgcaactaaagtaccgtttaatttccgtaacgtagattcgttaatcgccttataattagccttcgttccgtcggtatggatcacgtcaatatttaataacggatacccaatctcggaacatccatcgcttttcagcgccttaaccaagtcgtctaactcataatctcgccaatcggtataaaaacctaaatgtcccgtatgaacgcccacaaagcgaactcgatcaataattggtaagtacttctggattgccgatagtaaagtgccgtcgccgccaatcgtgattaccaccgtggggtcttgatcatccaaagcaatgtgattttcccgtaagatttggctcaaatcttggccgacttcgatcgagtgttcgtcacctgaatggtagattgctattttcattttattcatcacgttgttccctttgtgctaataaaatttgtttacgaatgtctgacatttctttgtctaattcgtacgacttaacggatgccttctgcaagcgagttcgtagctctgcagggaaattaccgttaaacttgtaatttagcgaatgttcgatggttgcccagaaattcatttctaaagtccggacttgaatttcagccaagactttcttttgcccggttaacatttgaactgggtattcaatcacgatgtggtatgaccgatacccacttggcttttcattttccacataatcccgctcttcaatcacggtcatgtcggttcgttttcggatcaggtcaaccacttgataaatgtcttctacaaactgacacattacccgcacgcccgcgatatcttgcatatcctgttcgattcgttcttctaaaatttggcgccgaaccatcttttctttaatactatctaccggcttcacacgcccagtaacgaattcaattggactttcttcgtcacttcttaaaaattgtgtgcgcattgctcttagcttaacttttagctctgaaacagcctgtgcatacggcaataaaaaactattccaatcttcaatcatacggatccccccgaatcaatttaacaacctcttctattttatcatagaaacacgctcaactattttaaacattctccagagtttttcaagcaaaataattgcttttatgccataatttgttaaagtataatcagtttgacttacgtattctttggaggaatttaaatgctggaaacataccttttcatcactccgtggggtgatgaatgcttcaaatgtgaaaaggagaccattcgctattttggccgtgctgaggaaaaagtagatttaaaaatcttcctggttttaaatatgcaggttgtcttaaactatatgaagcataaccaagtcaaaaatggtaattacaacgacctatttaaccgcatgtatttaacttgcctcgattacaaggctgcttgttaccaagggcgtgctaagggccgccagttcctagttgccatgcaaaagtcagtaatcgacaagggcgaaagctattctatcgaactaggcagtcaacttgctcaacaagttggtttagacttaaccatgtttgaagatgaccggcgttctgaaatggtccaaaaggaatttaaacatgaccaacaattggcccatgaaatgggtgccgaaagcatccccgctgcggtgatctttaacgtaaaagatgaggaatatggcattttaatggatcattatgattaccagaccctcgcttcagtttgtaaactgaaactagcatctgatgacgataattcatttattcccgagacactttagcttgttagagcaccgaaattatttttctgattaatagaatttcaagacaaattctattcagggagttgtcttgaaatttatttagccagacttattctcataccacagcaaatttaaaggctggattaagttccagccttttttgtaaaatctttccagcaatttactttctcaattcattaagattacctttcaaagcattcattttggtagatgcatccggaaaccaagtaactgcctcccctcgaaactgccaccgttgctcccgtttaactatccaatgatgattaactaagtaattccaaaattcttgatccacctcttcactaatccaaccattaacaccgattggttcttccagcataagtaaaatacaaatccgatttaaaattggcggactcaaatgccaaaaatccgtacagttttggggaacgtgtaccacccacggacaccctagtaaagaatggcccttttcataacaaagctgttgcaccttaagataacgttgatcaatttttgttcccaacacgtgtctttcaagttggcgaacttccctaattaagttcgttgaattagttaaagaatctggtttagtttgaatactaattttagaatcatttactagcaggggctgttttaagtaggtgattttgccaaatagttgccggtaaacttgataaaacaaccacggcgtattatcggctaaagcatcccacgctaaaaaccaccacccgtagcgcgtggcgtaccgaccaaacttttgcatcgtcgctagcagtcccttttccttacagtgttgcggtcctgcaatccagtaaacatgtttactgacttgctggtaatcgtatgttctttggcgaatttccgaaaccgtgatgggactacactggtattcaatcacgtagatttcgccatgtgcccgcaccaccacgtctccacgccgtttaatgcttggaaaataatattccgtctgcacttctaagcctaatttcataaagtaatctctaagtcgtgtttttccaattttgtgccgtcgactttcttcgctccctaattttggcttattctcagctacatgagcaaaatacttatttcgataatgtcctgcacatagtcgtaatggccggtggcattgtgggcaatagtatctgcccttagcaattgcagtagcggctttcaccaatttccccgtttctgttaatgcaaccttcattaaattcacctctattagcaaatacgcaagctaaaagagattattcacggaagtaaatgtttttacgcattttcataaaaatagcagctacttttccacaaaaaagaggttaaggaaaaatccgttcagatttccctaacctcaaagccgttttctggctaatcgttacgctttaaaatagtgttttgctaactctaaagcagcactatcaataattgttttcccgtgttcgcgaagtacttcgctagtaattgacgtttgatcgccatactcgtacgccaaagctaaattatccttgaccaactcgggagtattttcactcatatagaaaaccaactctaaatagtaactatctttatagcggtaaaggaccgaatccagaccgttcacatcgctaatcgcggccgcaattcctggtaagccctcaaaatcgttaagtttaattacctttgtttgggtgtcgtcactatcgctaccataactattaaagtctgccggatctgcatcacggctcggattgctcatattggcatcttgtccatcagtttcagcaagctttttcttcaagaaatcagagacttcatccagttcttcgttactaggtgattcgttcttcgctactgatttcattgcctcttccattccgttagcggggtttttactaatatacaattctaagccattacgatttggtaaaacttggaaagttactgcatcattgttagcaaattgatgatcagtatctacttcttctaatacagaataaaaaaagttttctatttctttgtgattatcaagcaagtctaggaaggtaactcccctttcgctcaaatcttctgagctgatcttgactcgaatggtatcttcattaattcgttccatttccattaagcagcacctccagtttagcgaaactgaatgaaaagaacccactaatattagtatatattaggttccccacgattatcccataaattcattaaaaattccactttcatagctgattcaaccatttttggtctgtaatcaagtaaaaatgaagaggggccggaaaaagtattttcctagccccttagtttgaactttacctattctttttaagatctcgtcagcgaaccgacatacctaattaatcattataaattagcaatcttttgtgcccttgccaattcaagctgtcttaccttacgtggtaagaagcgccgaatttcatcttcatagtatcccacttgtagacgcttgtcgtctactaagattggacgccgaagtaacccagggttcttttcaattaaatcaattaattgttttaaagaaagatcgtctaaatcgacatctaattcttggaaaacctttgagcgccgagaaacgatttcctctgtaccgttttcagttaactgcagaacttgtttaatctctgcagcacttaatggttcagaaaaaatatttctttccttatattgaataccatgttcttcaagccatgccttagctttccggcaagatgtgcaacttggtgaagtatataaattaaccataacgtatatcccccttaacgtcgttaaatattacctgtcttatggttaatattatacagttttaccgggtgtttgtctagaactatttttaaatttacttataaaaaataactaaaaataattcttaattcgggattaaagtttttacttatcgacctataatacttttaaagtaaaagtgttcaatacacgaaggagctatttttaaacataaccttataccaacaaaacacttttacttataataaaaaccttataattcgataacttttccggtagccggtaattcaatttttgttggatttgctgaaaaatgttgcgtttcttctaacattatttttggatcaatctttggcgacaagtgactaattattaaacgttgggcatgtgcgttatcaaacaattgcgcagtttctttagttgtcaggtgccatttaactccttgataatcactcaaaaagttcgtatccgtaattaacaaatcactattctgcgcaaaatcagctaattgcgcgaaataacgcgtatccgacgtaaaggtaaagactttacccgtggcaacttcctcaattctggtggcaaatgccgctaccggatgctgtgttttttcaaaggaaatcttcaatccccctactttaattacatcatttacttgataactaattcccttggacgcattgggccaggttagtgcaccaaaatttagcggatcttctgtatgtccataaatcggcaacgttgcaacttttttcttctcattcaattgccaacggtactgtaaaacacccagatcggctgtatgatcgtgatgataatgtgtgagtaaaaccgcgtctaggtctagtggatcgagatgcttttctaattctaagagagtagccgatccagcatcgagcaataaattagtatctttggtttgaactaggtaaccggtagtccccgtatttttacttggataaccaccatagtatcctaaaattgtaatcttcataaaatccctccatgtgacatcattaacccattttaacgcaaattaatatccttatcgaactttaatatttttagtttgtccattgtagcattataatggttataaaattggaggtgtttcaatgtttaaaacaattactacttctttcggcagctctgccgttttaaaatcgattcaaaaaaaatattcttcgcgaaagttactactactagctaatcagaacgataacgatagcttccagttagtcgatttttcaaatcaaccgacgatttttaaaactccccagcgctacaccgtcttgaattcttttgattcaatacaaaagaactcaatttttacgtaccactttttcgaacttagtacagatgcgttagatgctttcgatagtcaggttgataaccttgcaggcaagaccgccactaccctactgaatttaaagccgcttgatcaaaaaccatataatcgagcaattttagaaatctcccaaaatagtgcggtcccagagtccctacaagctcttataagtaaataccgtaatcaaaattattataaaactaattatcaggttgtcgggtaggtgttattttattacttttacagtatactggtatattgaatacgaagggagttgaaactaatctttcctaccaagaaaccacaaattcttatttataacatcatatttgacttgattgtaggaatcttttttgtctactacttgaaagtttctgcaaatttgtcaacctttctacgtgttattttaatggcttttgcagcttatgatttcaccgatatgttctttagtatcaaattacttcttgaacaacgtcggcgtaataaacataaataatgcattttaaaaactgatctcttcctatcgattattatgtctttagggagggatttttttgctaactaaccaactgtaatcttaccaaatgctcctaaacaggattactccgcaacccaaacaaaaaagcctaacccaaaatgagttaagctcttatcgtattcgaccaaaaggcggtagacggatttgaaccgacgatgaaggttttgcagacctctgccttaccacttggctataccgccataacaaataaaaaagtgtaatcacccgtgtaaaaaatacacgataattacacgaaacaaactttaattattttaatgcctccggtgggggtcgaacccacactcccgtgaaggaactggattttgagtccagcgcgtctgccaattccgccacagaggcaactaaaaaatctaacaaactgagttccaattacgaactcaaagggcggtaggtgggaatcgaacccacgcgtgccggagccacaatccggtgcgttaaccacttcgccactaccgccatcatggcagggatagtaggagttgaacccacactgacggttttggagaccgtagttctaccattaaactatatccctatcattgataataagtgactgttattaaatcaagtgaactatactgttcacaatggctcgggacagaatcgaactgccgacacatggagcttcaatccattgctctaccgactgagctaccgagccaaataatatatataaaatggtgcaacggtcctaacgagactcgaactcgtgatctcctgcgtgacaggcaggcgtcctaaccaactagaccataggaccaaaacacttttggaatggaggatacagggctcgaacctgtgacctcctgcttgtaaggcagatgctctcccaactgagctaatcctccaaaatgacccgtacgggattcgaacccatgttactgccgtgaaagggcagtgtcttaaccacttgaccaacgggtcagatcatattatacggagagtaagggattcgaacccttgaaacaggctttaacccgtttacatcatttccaatgatgctccttcggccaactcggacaactctccaaataaatgacttttgacaactatttaactatatcattgagaaaaatgattgtcaacacttttttaatgaatatctcattatttctcgtttcgaaatagcgtatcattggcactcaaatatagtaccaagttttaccatccttcgtcaatagcatttttaagaaaaccattataaaaaatggcactttcacaccaaaaggccacactgtgcgattcggtaacgcttgcaactgatcaacttttataaaatctttttactcagccaccttcgttatcaaattttgcccagactttttgtttaaggtgactcatgaaaatagttttactttcataagcaaacaaaaaagatcacgctaaatagcgtgatctttgcttatttatctgttaatcaattggacgcatcgttgggaatagaagcacgtcacgaattgaaggagcatcggttagcaacattactaagcggtcaattccgattcctaaaccgccagttggtggcataccgtattccaaagcttcaatgtagtcttcgtcaattccttctgcttcttcgttaccagcttcccgttctgcaacttgagtctcaaaacgttgccgctggtcaattgggtcgtttaattcggtaaaggcgtttccgtattcgttacctaagatatataattcaaaacgatccgtaaagcgtgggtcgtcagcattcttctttgctaacggcgagatttcaactggatgaccatagatgaagactggttgcttcaattgatcttgcaccttatcttcgaagaattcgtttataatgtgaccaactgtccaccatgattcgtattttacgccatgttcgtcagccaatttgcgggcttcttcaacagacatttctggccagaaatcaactccagcatacttcttaatcgcatcaaccatgtgtaaacgttcaaagtcttggttcaagtcgagctccgtaccttggtacgtaatcttgccgtcatctgaaacggcgttaaccgccgcctttaaaatgccttccgtttcgtccattacgtcgtggaagtcgtagtaagctacgtaagtttctagcatggtgaattctgggttatgacgagtgtcgattccttcattacggaaaactcgaccaatttcataaacgcgttccattccaccaacaattaatcgcttcaagtggagttccaaagcaattcgtaagtataaatcaatgtctaacgcattgtgatgggtaataaatggccgtgcgcttgctccacctgcttgagtgtggagaactggcgtttcaacttcagcgaatccatggtcgtctaggtagcgccgaattgccgatacgatcttggtccgtttacggaagcgttccatgctttcatcgtttgcaatcaaatctaaataacgttgccggtaaatttgctcaacgttttgtaaaccatgaaacttgtctggtaacggacgcagtgccttacttaagaaggtcaatgacgtaaccttgatagttaattcacccatgtccgtcttcattacgtccccagttactcctaggaaatcacctaaatcagcacgtttaaagattttgtagacgtcttcgcctaattcatccttacgtacgtaaagttgaatctttccagaacggtcctttaagtcagcaaaaccgacctttcccttaccgcgctttgaaaccatccgaccagcaacggttgcgacaacgccctgttcttcaatttcttcttttgacatgtcaccgtacttttcatgtaattgtgcggctaaatgtgttctttcaaaacgatggccaaacgggtcaattcccttgtcgcgtaattcttgcatcttttcacgacgtacccgtagttggtcattcatacttggttgttgcttctcgcccactatgtgatccccctctttaatttttcaaatataattattacttattaaaacggtaaaatgcaaccttatttcgcaactctactcattcgagagtctagcttttcaataaactggtcaaaaatatcgatcatttcttgttcagtttcggcagcatttaaggctaccttggttcgtgcagagtgtggcacccctttaaggtaatatgccgcttgaccccggaattcacgcggtccgatattttcacccttcaactcaactaagccatgcaaatgttccttagcaatcttaattttttctgctggggtaggttcgtcaatgagcgttccatcgttaaggtaggctgccaccttttgaagctcccatggattacctaaaacggcccggccaatcattaccgcgtcggcgcccacttcatctaacatccgtttagcgtcttggggcgtccttacgtctccattacccataaacggaatgtgcaattgactggcaacttcttttaagatgtcccaatcggcgtgaccagtgtacatttgtttccgggtccgaccgtgcattgctaaggcagctgctccagctcgttgtgcagctagggcattttccaccgcgtaaatgtgtttatcatcccagccagtccgcatttttacggttacgggctttttaacggcgtcggtaacgtaggaaaccatttcgtaaaccttattaggatctaacaaccaacgcgcccctgcatccgtattaaccactttgttaactgggcaacccatgttgatgtcgataatgtctgcttcagtgttttgatccacaaatttagcggcttccaccaaagtttccttagtaccgccaaaaatctggatactcattggatgttcgttggggtcaacttgcatcatacttaacgtttttttgttaccgtaaatgatgccccggtccgaaatcatttcacaaactaccagcccggcaccaaactgcttgcagatcacccgaaaggccgtgttagtcaccccagccatcggtgcaacaactaattgatttgggatcgttatatccccaattttccattccattttttcacctcatcaaactttttatgcatgcagaatatgatagcacacaaaattgcgattgtggaggaaccgcgggatccttattacacaaattttggcaaattacttttcatcaatgattttttgcaaatcagcttcggagaattgatactggttgccgcagaaccggcaaactgcttgtgctccctgatctttatcgatcatttcttgaagctcttccgtagggagggaagctaatgattgtgcaaagcgttctttagaacaatcgcattcaaatttaacgtccattttatctaaaattttaacctgatcgtccttaaaaatgtcgtttaaaatttcttccggggtcttgccgttacgaagcatttctgaaatcaacggaatttcctttaaccgcgcttgcaagcgatcaattgcatcatccgtagcgtctggcattacttgaatcaagaagccccctgctacgccaaccgtttcgtccgggttcacaaagactgacactcctaccgccgaaggaatctgttcagattgtgcaaggtagtacgtgaagtcgtcgccaatttcaccagaaactaacccaacttgtccggtaaacggatcgccaagtcccatatccttagtaactgccataaccccttggttaccaactgcttggcccacttcaatatggtggtcttccttcagcggcaaagatacgtgcggatgctgaaggtaacccttaaccgttcccttggcattgccatccaccacgatggtgcccaccggaccgccaccattaatttttaccgtaagcttttcttcaccctttaaaacggatgaagacagtaacaaggtcgctgttaatgaacgccctaatgctgccgtagccgcgctccacgaatcgtggcgttgttgggcttcttgaaccaagttagtggtattaactgcgtaagcccgaaacatcccgtcattaacaatactttttattaaataatcactcattgagtatgctcctttcgcaaaaaaatcgtgagtgcattgggcaacccacgattctttggctattaatttgttgaaccgtcgtcatgatcctcgtcattaggatagtaaacggtcgtgccttcattatctttagcgttggattccttaacggagttagccgcttgttcgtggcgttcagcttccttgcgttctaattcacgcttagcttcttcgaacgttgcagctttttcgcttggaaattcagtgtccgatttcttttccggcatcttaccagtcttgaacaaactgagaatttgcttttcatccaaggtttcgtacttaagcaaagcttccgcaataatcttgtgttgttcacgatgctcttggataatcttgcgagcttgttcgtaaccttcggtagtaaagcgccgaatttcttcgtcaatggttgcggcagtcttttcagagtatgccggtccgctttcgccgtagtaggattgtccaggtgcagccaattctacttgaccgatcttatcactcatcccgtactgcataaccattgagcgggcaatttgcgtagcttgttcgaagtcatttgaagctcccgaagattgttgattgaaaataatttcttcagcagcacgaccacccatcaaaccagcaatctgttccatcgcgtctttcttagacatcagcatttggtcttcacgcggtagcataatcgcgtaaccacctgcacgcccccgcggaacaatggtaactttatgcacgacccgggcatcgttgagaactaacccaacaatggtatgtccagcttcgtggtaagccaccgtttgccgttccttcttgctgaccaccgcattcttcttcgctggtccagcaattacccggtcttcggcttcgtctaagtcggctgcgtcgataaccttcttattacgccgggcagctaacagcgccgcctcgttaagcaagttttccaaatctgcccctacaaaaccaggagtttgtttagcaatctcagctaggtcaacgtcgctagcaattggtttgttttttgcatggacgtgtaagatggcttcccgaccattaacgtctggccgaccaaccaagatcttccggtcaaaacgacctggacgaagcaacgcaggatccaatacgtccgaacggttagtagccgccatgacgattaccccttcgttaccggtaaatccgtccatttcaaccagtaattggttcaaggtttgttcacgttcatcatgaccgccgccagtgccgttgccccgacgccgtccaaccgcatcaatttcatcaataaagatgatcgatggggcgttcttctttgcttggtcaaacaagtcccgaactcggctagcaccgaccccgacgaacatttctacgaagtctgaaccagaaattgagtagaacggaaccccggcttcaccggctaccgctttggctagtaaagttttacctgtcccgggaggtccctcaagcagaaccccggctggaattcgagcacctaattgcacgaacttccgcggatcttttaagaattcaactacttccactaattcttgcttttcttcttcttctccagctacgtcagagaaacgaactttattggcactcttatctgcgggtttaaccttcgatttaccaaagttcattactcctttgccagcgccgccttgtccggcctgacccatcatcatgtagaaaatgaaaataaagaagattaatggcaatcccgttacgaggagttgaacccagaagctactcgattcttcttccttagtacttacctttactccatcagatgatgcagttttggtgatttgggagacggtcgagtcattctgtagtaccgaagtttggaacccggttaccttactagatgaaactgttccggggaataaccctgtggcagtatcatcctcttgcgcagaacgatatttaccagtgatcttatacacaccatttgatggctgaatatcaaaacttttcacgttgtcttttttaagctgtgaaataaactcgcttgacgaaatggtggaggtttggttgttgccacccttgcccactaccgcagcgataattcccataatactcaaaaaaactacgatatagaaaagactatttttaaacagcccatttctgttatttttcatgtagttcctccttgtaaggcatcaagacgcattaattttaatcttgactgttgtcgatataatatcacatttgactaactttgaccaatgtttttactcataaatttccggctttaaaacacccacgtacggtaaattgcggtaataaccttggtaatctagcccgtatccgaccacaaattcgtttggaaccgtaaagcccacgtagtctgccgtagcttccacatcgcgaccggcaggcttatccaagaagctacaaattttaacactcttcgcgttacgggaatatagtaaatccattacgtagcgtaaagtccgtccagtatccacaatgtcttcaatgatcagcacgtcacggccactaacatcttcggagatatcggtaattaattcaacttttccgcttgattgagtgccgccgttataactagatacgtcaataaaatcgatctgtgcataaccatcaaattcgcggaccacgtccgttgtgaaaaacatggcccccgtcaatacgcttaaaatcaacgggcgtttaccagcataatccttcgtcaattgcttacctaaacgttggcaagcttcttttatatctgcctcactgtataaaactttggcgatatcattgtccatggggacgtcctccagttctatattccaaaatatattttgtttgcgttgctaagtagggttcggctaaccatgcttgtcttaaaccgagtacccacaaaaccctttggtcgccgtccacaactgcccaaaaattcgctcgctgttcacgaggaaccttttgatcgattaattcccgtcgaacagtcttatacttgccgttttttaaccgtaaccgatcttggggggttgcctgacgaacaaaaagcggttgcttaagctgattgttactcaacaccattgctccggcaaccggtccagcaacggaacggtcgctgattcgaaattgagtaccctcatctaaagttaaccacttgttcaatgttaccatatgctttttagcttgttcactttttacggtcttttttttgattatttgtaataaatcgtacgtgatttccagtacataatcgttacctaaatcaatcgaaccctgcgctaaattagtttgattaataaattctaaaacttcatccagcttattttgtccaattgccactgcgggacaagactcgctgaccagctgttttaacagttgtttttgccataatcgcgactccgctttgaacttcggtaactgatattgactcccctgccggagctgcgctagtttttgtcgactaatttctttgatcaattggtcttgttcggtaatctcggtttggtattgtccaatatgctccaccacgcgcggattttccgcttgcaaggcggggagcaactgattacgcacccggttacgcaaataatcatcctgttggttagtttcatcttcaaaccaagttagatgattttcctgcgcaagcgctactaaagtcggcttgctaatttttaaaaatggccgcactaaacgcccggtcgcaaaagaccgctcctcgggagtgccgcgtaactggcttaaccaacctccgcgcaccacttgcataaggaaactttcagcctgttcggtagcgttatgagccgtcaagagggtgtttgcgtgataccgttgcattaccttggcaaaaaaatcatacctaaaccgtcgagcagcagcttccactcccgtatcaggatgcagttctctagaccacttagtacttacaaacgtcagtcgtcgttttgcacaccattgtcgcaaaaattcctcttcttgcacgctttgggaacgtagttggtggttaacgtgggcaataactagccgattttcagcgagattagacgctgctaaaagcgcgttgattaataccgtggagtccactcctgtcgagaccgctacgaccaccggcgcttgattcaattgataatggtcaacaattttttcacccagcgcccttaaactaatcattagttgcgccgtccaccgcgtccgccgcgtttaccatccgtatttttcttaagcatggaaagacgggattcgctgtcctttaaaaagcccgatagcatttggtcaaacgattcgtttgcgtttgaatgatgctgttttgcttggtgattagattgatgattgaattgccggtcgtctcgtgaatgatggtattcatgagacttcttcggtgctgcttgcgccggccgctctaccgccttgcgaatggataaagcaatcttaccgtcatcagcaatcgaaagtaccttcaccgtaaccgaatcgcctaccttaagtacgctgtgaatatccttaacaaaactatcagaaacttcactgatatgaactaagccagaccgatgctcccctaaatctacaaaagctccaaaattagtgattccagaaactttcccatctaccttagttccaacttcaattgacataaatccgtatgttcctcctaaaaaatttaatgtctaattataccatttcttactagtggcttgcgagctgtcgacccggagaaatttattttcaacggtcatgaaaaaaattggacgttgttgaaaatttttaagaaattatacattcgaaaacgggtcacttaacagaaaaaagtgaaaaacaggattggttttcaaaaccctgcttttcacttcttaaaacgactattcaatttcaaaaattcattaatttaatctggttttaccattacttggcatcgttaggtaagttatataccgtttcaccttttttagtgtagaagtacttagcccggattaacttttccaaataattttcatcattcatttgcttaaccttgtcttttaactgggcattttcatccttcatttttgtgtagcgtgccgattccaccgcaagttttgcattcacgctattttgagacacctttgcgtggactatttggaacaaaaagaccgccgcaaccgccgcaaaaactcctaagataactaaagcacgttttttccgtgcccgtgcataaggattcggtgctccggttgccgtccggtaactcattttgctgtgattttttttctgatgatgttgattatttgtcattgttatatccccttaatcacttccgattataacaacgcttacctagcctgtccacgcatatttaccaagttttaaattgttttctaaaatcttgttgatagttttcagaaataatcgtatacattcgttccgcatcgtcttttttggttgtatccaacagctgttccacccggatcaccaacgttttatttccaaaacggatttcaacttgatcgttaggaaccacgtttgatgaagactttgctaccttatcattgattaaaattcggccctggtcagcaacttcctttgccaacgcccgccgtttaataattcgcgaaacttttaaaaatttatctagtctcatttaactatcctttgtattgttcttattatttttttgccaaaggggatcgtcaaccactctcggagggtgaagacccgattaattagcacgaaacttagccaagttaacgcaccaattagcgctgccactgccgtaattagcaaagcagctccccgactatcacttgaaaccaacactcgtaaaaatccggtgattagttgcacaacgccaaacatcaccgcgtttccaattaacaattttagtaaaaagtggttttctaggtaaaccctctttaacagccgcactggtaacgcccaactcatcgcgccagcaatgattaccaaactaaggacggttatccaacttgcgccagtaattgaccagtggcggaccgcccaaccattgcaaatcaccttgacgcaaagaccggccgcaatcgcccaaaacgtcatctttaagcgccccatgctttgtaaaacactattattaacaaaaatcaacgccgccaaaattacgctgagattataaattgccaaagcgcccgaaccagcgaaactaccgaagagcagccggttgataaacggcattaaagtaatcatccccacgctagctgccgatgaaattgccaccgccactcggattagcgaagttgccgagcgataaaagcccccggaatcacgtttttgcaaagcttcggtcaacgaaggcaataacgtggtcgcaaacgcggtcgcgattaccgttccgacttgtactaatggctgggcgcggtcgtaaactccttttagagcttttgcggcgtcaggtaacattcccgccgccactagattatttttaacggtaaacgaatccactaactgaagcaggataatcatcgccgaaagcaggcaaattagcccgccttccaccacgaaccgttttcctaaatctttaaatacggaccattgaaagtgagcggtaccttcatgcatgatcttacggattactggtataaaaaaccagcttgcagctaccgcggctacggtagaactagccatcgcgtaagcgcccattttgtaaaccgaccagtcttgctgcaccgtgattatcgccaccaaaatgatgatgcttacccggaccacttgttcgacaacttgcgattttgccgttggaataacgttataaattccttggtagtatccccgtcccgttgctaaaaacggcatcagcaaaaacatggttgctacgacccggagcatcggcgccagctgacggtcccccattgcctgagcaatcgactgcgcgccgccgaccagtatcaaaaacaccgtcgcggaaagcaccgttaggatcattacagagtactggccaagcactaattttcttttttcatcaggttcttcggcaatgattttagaaataaagttgggatacccattaagcgcgaaggtcatcccaattccgtaaatcggataaatttgttggtatacgtaaaaaccggtgttacccaccaaattttggagaggaatccggtaaacggcgctcaaaaccttagcgataatcgcggcaaccgatagaatgaaggctccccgcattgctttttgctcggttatttttttcaagtcgcttcctcacagatattcagctaattttttaacgtagctcattagttgctcaaaccaatcttgttgcgtcatttgcggttgaataactaactttatatgcattttatcatttgattccgccactgtcgctcgcagtttagtaaccgatagcgcggcaaagacgttttcgccgctgatccgctggcttgccgccggagttaaggtaatgaacaagttgccatttttccgctcaattttttctacctgcgcagcatccgcgtgtaatttaagctcggtaatttgaatcaagttggcaacttcggttgggtattcgccaaaccggtcaatcaaatcatccaccacgtccatcaagccatcagtggaatcaacttgccggagtcgtttgtaaaattcaattttttgctgtgagtcttcaatgtacgtacttggaagaaaggcttcgatttccaaatcaatttcactatcagaacgtttaggaaccttcttgccctgcttttgcttaactgcatcagccagcatttgcgaatacaagtcgtacccaaccgaatcaatgaacccgtgttgctgtttaccaagtaagttacccgcaccccgaatcgaaaggtcgcgcatggcgattttaaagccggatcccaattcggtgaagtctttaatggcttccaggcgtttttcccccaactcagtcaagacccggtccctttggtaaaggaagtacgcgtacgcaactcgagaggagcgcccgattcgtccccgcagttgataaagttgggaaaggcccatgtgatcagcgttttctacaaatagggtattggcgttgggaatgtcgatgccggtttcaataatcgtggtcgttaccagcacgtcgtattcaccctcaatgaaatcaaacaaaatatcttctaattgtttttcggtcatttgaccgtgaatgtaggcaacccgtgcttcggggaccaatgcctcaatttgggcaaccaccttttcaatgtcttgcacccgattatgcaagaagaatacctggccgtcccgccggatttcacgcataattccttcgcggataatcccggcattttcttcaaccacgtaggtttgaatcgggtaacggttggttggcggagtttcaattactgaaagatcgcgtaccccaatcattgacatgttcaacgtgcggggaattggggtagcagtgagggtgaggacgtccacttgagaacgcaaagctttaatccgttctttatgtttcaccccgaagcgttgttcctcatcaatcactaacaggcctaaatccttaaattgaacgtcctttgatagcagtcggtgagtgcccactacgatgtcaatggtgccgtcttccaaccctgctaaggcttccttaatttgcgcgttagtttgaaaacgggacagcatcgcggtcgtaattggataatctccaaaacggtcgttcatcgtgtcgaaatgttgttgcgctaaaattgtcgtcggtacgagaattgccacctgcttgccaccttcaatcgccttaaaagcagctcgcagggcaacttcggtcttcccataacccacgtcgccaactagcagtcggtccattggccggggcttttccatgtcttccttaacttcctttatggaccgcaattggtcaggagtttcggtgtaaggaaagtcattttcaaattgtaattgcagatcgtcatccggtggaaaggcaaaccccttttcggcctcccgtttggcatatagttcaattaaatcatccgcaatgtcttcaattttagaagcaatgtgttgcttagtcttagcccagtcagatccgcccagccggttgatcttcgggcgcttgccttccgccgccacgtatttttgaactaaattaagctgggtaaccggaatgaaaagctgtccgctgccctggtattggatggtaaggtaatcttggtgaactccatcaacttccatggtggtcattcccaagtatttaccaatcccgtgattgacgtgcaccacaaaatctccgggctttaactcggtataactttttaaccgttccgcattttcaatgtgctgttggcgcggccgctttttgcgaactttggcaaacagttccttttcagtaagcaccaccattttggcgtcgggcatttcaaacccttgtgaaaaggattgcccaataatgttgaccgccccggtaactatccgatctgcttgcacggttcgtgattcgatttcaaaatcacgcaacgtgctggcaattttactttgccgctctttagaattggcaaaaatcaagacggtggcgtgccggctcatccaccgttccacttcgccctttaaaacgggcatttggccaaagaattcctggaccgctctggtagtaatttccgttagttggtcaaacttaagccggcccatccccttctgaaacatcgataaaaagatttggggctgctttttttgccggattaattggcggatttctaagcctaacggatcattgtctaacaaaacgttgttctttaactggtcgacaatccaactagcctcatttttttgaatatctaactccgcatccaaaatccgcgggtagtcgtcaaccacgagcaccccgtcagctaaataatcgagcagcgaattaggctttgcgtagagttgcttagtgtagataacgtcttctgggataatctggtgcttttgccagcgttccgtaacttccgcaatgttttgctgtaaaagttcttggttatcttcatccagccgtttacgcgcttgctgaacttgtttttgtaacttagcgattccttgatggaattgttcttcagtcacaatcagatccgtcgccggtaagattttagtctgggtaatattttcgatactgcgttggttattttggtcgaaagttcgaagtgaatctacctcaacgtcaaaaaagtctacgcgcactggaacgtcctggttaagcggaaaaatatccacgattgaaccgcgaacggcaaattccgatttcttttctacctgttcgacccgttggtatcccagttggactagctgttgaactagctgttgcgggtcgtattcttcccccacgctaatttctagctgggcctgcttaacgtctgcggccgccgggaccattcgccgaaaaccagaagcagaggtaacataaattccccgttgctgattagcgagggcgtttaaaaaacgtacccgtgccgtccggtagttgggcgaactggtcgccacctctgccgcgataatctcttctgccggaaaccagtaggcctgtaagtccagttgcccttctgctaactcgttatacagtcgttccgcgtgtgccaagctatccgttaccactaaaattggttgattttgtttctgtaataacgcattcaaaaacagttgtttggccggttctaataaaccggtcactaattgacgggtttgcgctcctaaattgctagtaacctcaacaactgccttggtgtctgaaaaaattttttcaatattcatacttgccccactaattatattgattcatcaactgactaaattccgcgcccgctagccagtcgtcgagcgccgcaattgcgttttgtacgccaatttcaaaatccgctttttgttcttttgtaaatcttccaagcacataatccaccactttttggtgtgctgggtgttcgattcccacccggagccggcgaaacttttcggtacctaagtgggcaatcaaactcttaatcccgttatgcccgcctgccgaacccttttgtcgcaaacgaattttccccaccggcatgtccatgtcatcataaaccacgatcaaatccgttaatgctaagtcatagtagtccattaacggacgtaccgctcgcccagaatcgttcatgtaggtagttggtttcactaataaaaccttttcaccgtttaagaaaaattcgccaaccatggcctcgtgatgaatcttaaaatgattcaccccatactttttagctagtgcgtctaccaccataaagccggtgttgtgccgcgtttgatcatattcttttccaatgtttcctaaaccaacaatcattttcattatttatcatcctcatacgcaaaaatagctgaaaggaatccgccccttcagcttgagctcgttttaaataatcttatcatatatcgccacaaaagcttagatattacttctgttcgctcggtaattatttttggcaaacttatttgttttctgaaaattaggtctcaactttcccctgttaaaatgctataatactttggtggaccaaatatataatctaataaatgaagggaatggatattatgtctaatattcaaaatcatcaaaaagttgtcctcgtcggtgacggtgccgtaggttctagttacgcattcgcgatggcacaacaaggaatcgctgaagaattcgtcattgtcgacgttgttaaggatcgtacagttggggacgcattggaccttgaagatgctactccattcacagctccaaagaacatctactctggtgaatactcagactgcaaggatgctgacttagttgttatcacagctggcgcaccacaaaagccaggtgaaacacgtcttgaccttgttaacaagaacttaaacatcctttcaacgattgttaaaccagttgttgattctggttttgatggtatcttccttgttgctgctaacccagttgatatccttacttacgcaacatggaaattctctggcttccctaaggaaaaagttatcggttcaggtatctcacttgacacagctcgtttgcgcgtagctcttggtaagaaattcaacgttagcccagaatctgtagatgcttacatcttaggtgaacatggtgacagtgaatttgctgcttactcatcagctacaatcggtacaaagccattgcttgaaatcgctaaagaagaaggcgtttcaactgacgaattggctgaaatcgaagacagcgtacgtaacaaagcttacgaaatcatcaacaagaagggtgctacattctacggtgttggtactgcattgatgcgcatttctaaagcaattcttcgcgacgaaaacgccgtattgcctgttggtgcatacatggatggcgaatatggtttgaacgacatttacattggtactcctgcagttatcaatggtcaaggtctaaaccgcgttatcgaagcaccacttagcgatgacgaaaagaagaagatgactgactcagcaactactttgaagaaggttcttactgacggtctaaacgctcttgctgaaaaacaagacaaataatcattaaatttatcaacgaaagcaccggttgcaaccggtgctttttttgtacctatttttatgtcccttccccaaacagcttgtactaaaatcagttaattgtgcaaatattggtgtcaaacccagatttttttgttaagattcgcatagtagacttgatatattcgaaatattacagtaatgttacagaagaaagtaaaagtaaaagtaaagaattaaatcatttgggggaagtactatgcaacaacgcaaacatcagcaccagcagccacaccattctaagatcgccatcacaatcggcgcggtggttatcttagggttgggctacgctggaatggcccaccattataaatctagtagcaccttcatgccaaatacaacggtagcaggtactaacgtgggcggaaaaaacgccacccaagcacaacaactaattgaaaagcacttaagcaaccaaaaattaaatttaactgctaacggcaaagttgttaaaaaagttagcctagctgacgccggacttaactcaaccagtcggcaatccatcaccagcgcaattaagtcacagaacccttggacgtggcctcttcagttaatggacgtggctaacgcagctgacactcctagtgttaaccttgatcaagcggggactaaaaaactaaatgattacgcgcagactgctgccgaccagctgaaccaaaagttaaactccagcaccaattcaactggccacgtagttagccccgaaattttggcacaacaaatccaggctagcacggctaaaggtgctcacgagctagatttaaagaacacctattactctaagaaaaacaacgcagcccaagtcaagttgcaacgcattcaggcggaaaacgaaaaaatcacttacgatgtgaacggcaacaccgtcgtaattccccaagcgactctgaagagttggcttaaaattaagactgatgctcaaggtcagcaaaaattaagcgttgatcaatctaaggtgaaggcttatttagcagatttaaaccaaaaatacgctacttatggtgcggacgtgaccttcaacagtactaagcgcggtacccaaaccgttaaggatggcatttttggctggtcaatcaataccacggccgatgcggccaacttgagtaccaacattctcaagggtgcaagtttcacccagaaagccaccatcgttggctccggacagtctttgaaaaagggcgaactcggaaccacgtacgtggaagttgataaaactaaccaacacatgtggtactacaaagatggtaaactacaaatttctaccgacgtggtaactggaaaaccatcgggtggcaatactacgcctacgggagtcttttacgtttggaataaacagcgtaacgcaacgctgcgtggtaaaaatgacgacggctctaactatgcatcacccgtgaactactggatgccaattgattacaccggggtcggccttcacgatgcttcttggcaacctaaatttggtggcgattggtacaagacccatggttcacatggctgtgtcaacaccccacccgcaacgatgaaaaaattattcgaagctgtcccagttggaactccggtagtggtattctaacgtcttaatctatgctattattaaaaacagattaagatatggagggtaatccataatgttattaaaatcaatggttaaacccaagcaacgcctaactaccgttcaagaagatgccacgctcgaagaggcacttaaaattttagaagactcgggttttcgttgcgtccccattttagataaaacgggacggctctttcgcgggaacatttacaaaatgcacatttatcggcataagtcgcggggaggatcaatgcaagacccggtgactagtttactgaaaaacgcgactaagtacattaacttgagtgccgcgtttttcaccgtattttttaccatcaaggacttgccgtacattaccgttttagacgacaataactatttttacggaatcttgacccatgcccggctattagacgccctttcccaatcttggaacactaacgtagggagttacgtaatcacggtggtttctagtgacgatcgtggcgatttagccactagtgcaaagatcattacgaagtacacctccattgcgagcgtcattactttggattccaacgaagacgaattaattcaccggacgctattcactttaccggcgggagtaccacctaaaaagttgcagcgcattattagcaatctagaacggaaaggctttaaagttcccgaagtcgaagatttgcagtcgcaccgccttgcttaagtttataagcatcaactaaaaaaggcgtctcaagaactaaaaaattcttgagacgcctttttaatttacaacgaccattgaaatttcaatagtcttttatgtattcgccaccaagcccaaactaactttgagggcttcgttgacgagtttcattttttggccgtccagacggccaattcgatcatgtagacgttgtttatcaattgttcgaatctgttccattaagattaccgaagcccgtggattaccggcttcgcctgcacgaatggcaacgtgggtgggcatcttcggtttagtaattctagtcgtaatggctgcaatgattaccgtcggactgtagtgattcccaacgttattttgaatcactaaaaccggacgcattcccccttgttcagaaccaacaactggtgacaagtctgcatagaacaaatcgccgcgttttaccttggattcgtccacagtgccaccccatattcaatctattaatttaatcactacttaacacgttaaatacgtgttcttcacaagccgcttcgcaggatgtaaaatcctgggtaatcttggcgttaatgtccgccatttgttggtagcccgcctttaagagctccaaatgttctgcagcatgacgctcaaaaaaagcatgaatcaactggtcacttaccccagtgggttcaacttcaaacatttcacaataaatctctttttcaatagatatatcccttagttgattactcattaggctcgctctcctgtattcctgattattactttcattctaccatcaatgaaattattttactatatcattattcttatagacccgcggaatccgctccgtaaagccacatgtgatttcataattaattgttccagcataatcagcaatgtccgtcatgctaatacttttcccttgcgatttccccgctaagattaccgaggttcccgccggatattcatgcggaaggcgaatcattaactggtccatgcaaactcggcccacgatttcacaaaaatgcccgtcaactaacacgtggaacccttgtaaacagcggggatacccatcggcatagccaattggaactgtcccaatccattcgtcttgttcagcagtgtaagttgctccatagcttaccgaacgcccctttttcaacagcttagaaaatgaaagctgggactctaacgtcatggctggctgcaaatcatacggtggttccaaaacggttccggacggattcatcccataaattccgaccccaaaccggattaggttaccgttgcaagctgcgtgccatagactagttgctgtattagaaacgtgaacgtagcgaggcttttctggcaaagtgtccactaatttatgaaaacggtccacttgaagattgaaataagtgggatccttttcatccgcggttgcaaagtgtgtaaatacaccttcaaaaacaaaacgcggatcattggtgagcaactccgccgcctgattaaggccatctgactcttgaaaaccaatccgtcccattccagtgtctaacgccaaatgaacctttaacggatgttctgccgttaactggggagccgccttagtcaaccactccacgtctcccacggttaaagaaacgttcttttcagcagctaaagccgcccactttacgttagtgattcctaagactaagattggttcagcaaaacccgcctctcgcagggtcaatgcctcgtctaaaattgccacgcaaaaaccggtggcgcccgcttgttcagtataccgggccaccggaatcagtccatgaccgtacgcatccgccttgatcacggcaaataactcgctttgcggatctaaacgttcaatttccttttttacattttgccgaattgccgccgcatcgactactagccgacttgcgcgatgccatccttcaaccattgttaatccccctctaagattacctgtgttacgacatggtgttttgaatgcgaaatcgacacgtgcgcaactcctgcaaagggatggttgctaattactggtcgaccgttgtcgtcatactcaacttcaatatcttgaaaattaagcttttttcctaatcccgtaccgtatgctttactataggattctttaactgaaaaatggccagccaaaaattcgtacgctcgctgaccgctcttacctgccaattcggcttgttctttatctgttaacactttcttgataaaagacgttggattgtgcaacgctttaaatcgatcaatgttggtaatgtcgatgccaattccgtagatcatgtgaatcctcccattgtcgtcatttattgtatcaaacttgcctttgaaaaaacatcccatcttaagcccttcatggcaagctttacatactaaacggctttttcagctacccccgctagtcctaagctaaattggtaaagtttttctaaaactgtgaaaacaaaaaatgaggcctgaaatcaaagctccagtaacctcattaaatgtttaaactttatttttctttaattacaaagtggcgcttattaccgcccttgttgttatcttgccggtggtttgaacctgcgtggcggtcatcccggtcccgacaatggccgttcttgcggtcgttccatttaccaccgttaccgttgcgccgatagccgttgccaccaccatggcgtcgaccgccgcggtagccgccactcttatggttaccgctcttcttgcgtggtaatgggcgttcaggggtaattttaaccttaatctcactcgcgtctgccttagtttcatcgttcaataaggcagctactaatgtacgcgcgtcgtattgttctaataaacggtctgcttgttcgccaaacttatcaacatcggtctttttaaccaattcttgcacgttttgttcagccattgctgcccgaccaatgaaggcttcttcttctgttggtggctttaatggaagcaagcgtttcttcgttaaacgttctacgtctcggaggtaatccatttcccagttagttacaaaggttacggaagttccgtgagcaccggcccgaccagtccggccaatccggtgaacgtaactttcaggatcctgcggaatgtcgtaattataaacgtgagtcaccccagagatatctaatccccgagccgcaacgtcagtagcaaccaagatgtccaactgtccatcgcggaattgatgtaagatattcatccgacgttgttgggttaggtctccatggattcccgctgcgttataaccgcgagcaactaatcccttagccacttcgtcaactcggcgctttgtccgaccgaagactactgccaacttaggtgattgtacgtcaataatccgggttaacatatcaaatttttcaaattctttagaacgaatgtagtactgatcaactaaatcagcggttagttcttttgacttaaccgtcacctgtttaggatcagtcataaacttaaccccaatctttttgattggtgcgggcatcgttgctgagaatagtaacgtttgtcgttcgcttggggtttgttcaataattttttcaatatctggtaagaatcccatgtccaacatgtcatctgcttcgtcaaggaccagggttttaacgtggtctaagcgaatagtgtgtcggccaatgtgatctaaaagtcggccgggagtccccacaacaatttgtgggtggctcttcaacgcattgatttgccggcgaatgtctgctccaccatacacaacttgaactttagctcgcttgtacttacccaatttaaagatttctgcttgggtttgggcagctaattcacgcgttggtgaaacgataattgcttgaatattaggattatctaggtcaacattttgtaagattggcaatccaaacgcagccgtttttccggttccggtttgtgcctgtccaataatatctttccccgctaagacatcgggaattgtttcagcttggattggagtgggttcatcgtatccattgtctaaaacagctttcaaaatgtcttcttccaaccctagttcggtaaatttcaaatataattcctcctaaatttctgctactgcatcaaagaaaatccgtcttttagggcaaagcccacagtaacaatcatgtaaacataactttataatcatacacccgcgaagtgggattagcaaataaaatagagagtggaagcccttggccagggtttgaggactaacttaatttagggcttaatcgcgggttaggcgattgagttctaaattgggttagccacagaaaactggggcctggagctcatttcctttctctaccatcgcgtgctttttaccctacaaaaaaagaccgggtttctccccggcctatgcttcgttatttaagctgttcaaccactttttccaaatgaatcccgtggctggcctttaatagtacacagtcatcagctttaatcatttgttgtaaatcagtagttaattgcggaagttcgtttgcgtcgtataaatgaacggcttctgctggataaatttcttcgtcaaccagccgttttcctaacgcccgcatatgctggcccacgagaaatacttcttcgaattgagccggatttaaactgtccgctaattgggcatgcatttggtcggcattttctcccagttctaacatatctcccagaaccacaaaccggcgcccggtcttcttagtatgtgcaaaggagtttaacactgctttagctgccgtaggattagaattatatacgtcacttaaaattcgttctccctgccggccttttagccattcggtccggttcttggttaagttaaaatctgccaatgcacgagcactgtccgcaactccgacgtggtatcgatcacctaccgtaatggctgccaacgcattttttacgttatattcgccaataattggtaatttaacctccacttcggggtccaaattagtcttaaatgatgtttcagtatcggtacctgctacatcggatgcgaatacgtcgttttcatttttcatcccaaacgtacgttgttcaacatccaccgccttggcccgctccgctagtaacggttcgtcaccatcgtaaataaagcaaccgtcttcctttaaaccgtccgtaatttccattttggcatccgcaatccggtctcgcgtcttaaagaattcaatgtgggcttcgccaatcatggtaattaccgcgatgtccggttggactaattcacttaagaaatgtaactgtccggggcggtccatccctaattcaaccactagaacctcagtattcgcgttcattcccaaaatggtgattggaaccccaatttcgttattgaagttggcttccgtcttcaccacgttaaattcggtcgccaaaatggcggcagtcatgtccttcgtcgtagtttttccgttacttcccgtaattgccacaactttgggattgattttatctaagtagtatttcgctaatttttgcaacgcagccagcggatcttccacttcaatacttggcaaatctgccgggcgggtatcttcatgatccttcgcccataacgttgcaaccgcgccagcctgaatagcctgctcaataaattggtgaccgtcgcgttgtcccttgattggaacaaacaaagaacccggcgttaattgacgactatcaaactggacactggtgacactaacctcattccattggtccggatactcgtctactcctagagcacgggcaatttcacttagttgcattttcatatttttaaagctccccctattcaaacctaccctcaattataccatagccacctttttggttactaaggcaacgggttcaaaaaagcccagtaaattttaccaaccaattcaatctagaaacatgccgtcaaaattagctttggttaacaaaaactggactttcatctcattagctactatataagtcgttaacatttcatttacagataaataacctgcattagtacaaggcttcggcatcaaatgccttgggattggtgataataaaatgccaatcctgattccttaaattatattttaacaccgcgatttgctgcgcttggttgtatagtgattctttactacgcaacgtgggggctaaattactatcactagcaattaaaattggcacccgcagttcgtggtcttgttcaatggcttgatcaaaagcaaaaatgacgccttcgccaagcactggaattagttgcctcaccatgctggccggcaattccgagaaatgattgacgcgccgaaaaaccaagcggtgttcgttatacgtctgttcggcatgccggattaccgactggtttaaaactgcgtaaaaattctttagccgccggtagtaagttttgacttggttagtccccacctctaagtaaacgtagtcgttttgcagtttgtacgaaaagggagtgtccaaatgactcttcatatgtcccatgtacagtaaattagcgatgtcattgggcgttaattcactaagtgcctctgcttgagaaaaatcgatccaatttttactgctgtgcggatcaagcaaatactgactaatcgtcttggcatcgttaatctcgtttaaaaaagtatggttatcgattggaacgtcgtcactaacttcccggtttaaaagtaaaatattggtcggcacctgcaaaattccacttaagaaatccttggcagtaattccgcgcgaataaattaagttaacaattgattctaaatgtacaaaaatatagtcgtcacgcaacatggacccttatctcactttcaattaaatgatttctttgattgatcaactcacattttctccagtcgagcaatgcgatcttcaattggcggatgggtatcaaacaaatgggctaacgagcgcttctttttaaaaggatccgcaatgtacaatgctgcgctgctcggatccgcttcctgcatcggttcgctagctgaaatcttttttaacgcgttaattaatcccaatggattccgcgtcagttctacacttgatgcatcagcgagatattcgcgatttcgggaaagagccagctgagcaatcgacgtggcaattggtcctaaaattacgagtaccaacgccagcaacattaagattgcccttaaactgctatcctcatcatcgtcgctgtctcggcggcggccgccaccccaccagaatgcatgcatcccccagttaactagcaatgaaactgctgctgaaagtgccaacgcaatcgtagaaaggcgaatatcgtaattacggatatgtgaaatctcgtggccaatcacaccttccatttcttcgcgatttaaacgcgccaaaattccggtggttaccgctaccgcggcattttgcgggttattcccggtagcaaaggcattcgggctaggatcgtctacaatgtacaccttaggcatcggaacctttcctactagtgccatatcttctacgatatgccatagctcgggatggtcagcttcgctaatttcggtcgcgtggttcattcgcattaccacgtttgtcgaattactaatcattaatcccatgtaaaccgcagcaataattgccgccattacaactcccgcactagcgctattgtaaaacacgtaaccgaccgatgctccaattaggagaaccaaaatcgcaaaaccaaccattacgtatacggtcttgcgtttgttacttgcaatttgttgatatagcatttattttccctcttaaaatagccttatttatcgaaagaaactttaggagcagcggtttcttcttctggaacttggaggtagtccaccgctttaaagcccccgattcccgctactaaattgctcgggaaagactgtagcttaatattataactagctacgcttgaattatacaattgccgtgagtacgcaatcttattttcggtattggtcaattcttccattaacttgttaaattcctggttagctttcaaatctggataattttctgaaagcgcaaaaatactttttaaagtatcactcaactggttagaagtttgcattgccgcttgccgttgggcagttgacgggtccgccaccttcgtttggtcaaccaactggttacgtaattccactaccttacttaaggtttccttttcgtgggttgcgtatcccttaaccgtgtttactaaattaggaattaagtcgttccgccgttttagctgaacgttaatttgactccaagattcttgcgtataagtccgcgcctttactaaaccgttatacatcaacacaattgccacaaccaagattgcaacaatgataatcccaatgaccattccactcattatttatccattcctttcaaagttacctgattaccttaatagtagcagactgccgccaaaaagccactaaattagcggttaaactatcgcgaaaatagtttttggacactagccggagcttcttggtgtttcatttctttaactaactttccccgaatcattagccgtcccgctccggttgcatcacaagtaactaacgtaagtaacttttggtccttaacgtcgtcaatcacctgtacatccgttgctttaataaacttccgggtggttacttgatattcgtaaatattcttttcgtccgtcaaatatactttttgtcccaccttggccttccaatataacggcccaaagagaaccttcttatcgatcatgtggtgaccagccagggcgtagttacccttgcccatcttttcattttccttaagcgttccggctgctagcgccaacgtcaaattgtcgactcctttaccaattggcaaatgaatccccacgtccgggtaggcaatctcgccaattaccttaattcgcttttccgacgcccgggctttaaccaccttcttccagtctagtgacttgacctttgaaaaattaaaatcagccttcttcttttcatttttagtgaccacctgttcactaacggtggggttgtactgcgataccatccacgttttgatctgtcgattgaaaattaatgctaaactaaaaataaccactaacgttaacgcaattgaactaagccatttttttaacttactattcatcttttagatctccaatatatatattttatttttgtggtattgtatataggtatacctttattttagaaagaaggcttttagatgttttctcatcgagaaggacgaactagaaaaaaacgcgaaccatggcagcaaaacctctttgtactatggttcggaacgtttattgccggtatcgcatttagtgagattatgccttttttgtccctttatgtcaatacactcggcaatttctcgaaatctcaattatcactatacagtggactaacttattcctcaacctttttagtgctagccatcatttcaccaatctggggaaagattgctgataaacgagggcgtaagctgatgatcttacgagcttccctcggaatggcgtttgttttaggcgcgatgggattagtccaaaatgtctaccaactaatcggcctccgtttgttacaaggggtctttgctggttacattagtaacgcaaacgccttaattgctacggaaactccgaaagaaaaaagcgggtacgccctcggtttcctatcaaccggtcctgtatccggctcccttttaggtcccctcgtcggtggagccctcgcttccatcttctcttatcgtatcacctttttcatcactggagcactattattaatcgtgttcttccttagtttattcttagttcacgaacactttgttccaatcgaaagcacggaaggttcgttaactgctaaagacgtggtacataagttgaaccgaccgcaagcagtttttgggatgtttatcaccaccatgattattcaagcttcgaataattccatcgccccaattattagtttgtacgttaaggagctgatgcataacggtgccggagttaccatggttgccggtttaatcgccgccatccccgggattgccaatatgcttgctgctccccggctgggtgaactcggcgaccgaattggaaccgagaaaattttatcggtcgccttcctatttgcaatggtcctttacgtaccgatggcgttcgtgccttcagtattctggttaggtgttttccgtttctttatcggcatctcggatggtgccatgttaccagcggtgcaaagtattttatctaagcgaacccctccggaagtcaccggacgaattttcagttggaaccaatcttttcaggcgttaggcaacatgattggtccgttattaggttcggcagtttcgggattgtttgattacaacgcggttttcattgccacttccgtattggtattaatcaacttcctcctcttccgttggttaaacggccggtccgttgcttaacagttcctagactttaaagactaattaccatgacaaaataaaaagagctaatccatgatggattagctcttttttgcttaccatttgacttaatattaagccaaaccgtatttcttgttgaacttcgcaaccgtaccgtcggcttgttggaacttttgacggccagtgtagaatgggtgagaatctgaagtaatttcaacccggattaatgggtattcgttaccatcttcccacttgattgtttcagaagatgatgcagttgaacctgataaaaaattgaacccagttgctgaatcttggaatacaactggatggtaatctggatgaattccttttttcatgatattacgctcctttgccatgaatcatttgctgaatcatagttattataaaaccaacgaccacaatcatagcataaattatcatttcaaacaacctcatttaggactttttgccgaaattaaggttcttcagattagcgataaactcatcgttattcttagtatttttcattaattgtagaatttgttcggtgtattctaacgcgtcgccacgcatggaccgccggatgttccacagctgttctaaaacatcccgtgaaatcatcaactcttctttacgagtgccggattgccgaatatctaatgctgggaaaacccgccgttctgctaagttgcgggataataccaattccgaatttccagtccccttgaattcctcgtaaattacatcgtccatgcgactaccagtatcgaccagggcggtgccaatgatggttaacgaaccgccttcttcaatgttgcgtgccgctccaaagaatttctttggcttataaaatgaagccggatcgaccccaccggaaagggtgcgtccgctcggtgccgtaactaaattatacgcccgggttaaacgagtaattgaatctagtaaaatgaccacgtcttgtttgtcttcaacgagacgcattgcccgttgtaaaaccagttcagaaacccgcgtatggttccggggttcttggtcaaaagttgaatagactacttcaccatcaatcgagcgttccaagtcggtcacttcttcgggtcgctcatcaatcagcagaacgattaacttcgcgttaggatggttcttactaattccgttggcaatggccttcaacaacgtcgtttttccagctttaggcggtgcgactactaatccccgttgaccaaatccaatcggcgcaaacaagtccaccaaccgtgttgataacacgtctggcgtagtcgctaacgtcagttgttggtttgggtaaattggcgttaaggctgggaaatgtggccgttgtttagcttcttcaggatccttattattcaccgaagttacccgcatcaatccgtaataacgttcgcctggccgcggatgccgcgcttcgccgcccactaaatctccgtttcgcaaaccaaaccgggtgatctgggaagctgaaatataaatatcttcttgggaagagccgtaattaatcggacgcagaaaaccgtagccttcgttgccgattatgtcgaggactccttccatttcaacaaatgactgctttttggcctgagcacgcaaaacagccagtgacaattccttcttgttcatctggctgtagtatgaaatcttgtattcacgcgcaaggttgtaaatttctttgagagtcatttcttgtaaatcattcatcgttaaaaatttatccatgaatattaactctcctaattgttaattctaaagcgattgatccgcagtaatttccacgtccgcacctagtttagtcaatttcttcactaaactatcgtaaccccgtaggatgttatctgctttggtgatcgtggtggtaccgtccgccatgaaggcagcaatcatcaaacaggccccggcccggatttcgcccgcttccacgtttgcaccatacaattggtcggtgtagtcgacgtaaattactccgtcggcgtgctgaatgttggctcccatcttttgcaattccgaaacgtgttttacccgttctggataaatgtggtcgttaaccacactgcgtccttgagcctttagtagcgaggcggttagcggttgttgcaaatcggttgcaaacccagggaatggattagtattgacctcaatcccccgcatcttttccacctttggtacgtagatcttgtccccgtcaattttcaaatccactcccaattcaatcatcttggaagtgaaggattcgagatgttcgggaatgatgttattaactaaaatcccatcacccacggcagctgctaaggataggtatgtacccgcttcaatccggtctggaataatggtgtgggtcgccgtggaaacaagcttgtcgaccccttcgatccggatcacgtccgtcccggccccccgaatcttagcccccatgttatttaagaacatggctaggtcaataatttcaggttcccgagcggcattttcaatggtggtaactccttgagcttttaccgctgctaaaattacgttaatggtggctccaacagaaaccacgtctaaaaagatgtgggccccgtgcaatccccgctcgtaagcagaaatgtaaaccgtgtcctcatcttcagtaacgttagctcccagagccttgaaccccttaatgtgctgatcaattggtcgcggaccaatgttatcaccaccggggaaagtaacggtggaacgcttgaagcgtcctaaaagcgagcccataaagtagtatgaagctcgtaaactcttaatcgctttacttggtagtgggttttcgacaatttccgtcgggtcgatttccatcacgccatctttaaaggttgaatgaacattcattgattcaagaataatcattaagttatggacgtcaagtatatcgggtaccgaatcaaaccgcactggggtgtccgctaaaatggccgccggtattagagcaaccgtactattttttgctccgccaatggacacttctccagtcagtcgctgtccacccttgattatcatttttttcatggtttttcctcacataatgaacttaaagtacttaaaactaaggaatgtattttacagtcaacttcaatcataaataatttgttgcaaaaatacaaccacaagccttcacctattaaaaaaactcaaacatccttatgtaaaaacgaggccggaaacctagtccgacctcgttgaagtagtagttagtaaactaattatttactttggttagcggccgcaataaatgccttgaataatccttccggacgttgtggccgtgaaaggaattcgggatggtactgtgaagcaacgaagaagcgcttgtccggaatttcaattacttctacaaggtggttatctggtgaagtacctgagaataccaatcccttagcttccatttcagcacggtattggttgttaaattcaaagcggtgacggtgacgttcttgaatcaattcttgattatcgtacgcccgggccgcaacggtaccttccttcaacttgcatgggtataaacctaatcgttgggttcccccaaggtcttcgacatcctcttggtccgccatcaagtcaatgatgttgtgcggcgtgttaggattcatttctgcagagttggcatcttggtaacctaatacgttacgcgcgaattccacgctggccatttgcattcccaagcagattcctaagaacggcacgtcgttttcccgagcgtattgaattgcgtcgatcattccttcaattccccggtctccgaagccgccgggcacgatgattccgtcttggccagccatcaattcagcaacgttttccttagtaattttttctgaatcaaacttcgtgatcttaatgtccgcattcacaacgtagcccgcgtgtttcaaggcttcgttaactgaaatgtaggcatcttgcaaagcaacgtacttaccaaccaacgcgatgttaatcgtgtggtcaaggcggttgtttacgtgatcaacgaggtccgcccacttagccatgtccgcttctggaacgtctaagccaaagtgcttaacgacaatttcatccattttttggcgttttagatttaacggaatttcatacaaacttgccacgtctttagattcaattaccgcttcaggctcaacatcacagaaagcagcgatcttcgaacgcatgctgtccgtaatatcttcttcagtacggactaccagcatgtttggctgaattcctaaaccacgtaattccttaacactatgttgggttggcttagttttcatttcaccagccgccttaaggtaaggtaccaacgtagtgtggatataaaatacgttttgggcacccgcttggctccgcatttgccgaattgcttctaagaatggcaaggattcaatatccccaaccgttccaccgatttcggtaatgacgatatctgaatccgtaacggttccagcacgcatgattttttccttgattgcgtcagtgatgtgcggaattacttggacagttgcgccaagataatctccgtgccgctccttacgcaatacttccgaataaatttttccagtggtaacgttagaatacttatttaagttaatatcaataaaacgttcataatgtcctaaatccaagtccgtttctgtaccatcatcggtaacaaaaacttccccatgttggtacggactcatcgttcctggatcaacgttaatgtacggatcaaacttttgaattgtcaccttcaaaccgcgatttttcaacaaccgtgctaaagaagctgcaacaatcccctttcctaaagatgaaaccactccacctgtaacgaaaatatatttggtcatcaaaactctccttttctaacatttctaactggttaactattaggaaacctgaaagcggattttatcatcgggtaaccctcacccaacaataaaaataccccctattccatgaatagggggtattaaccgttcattgtccgctaaacccaatcaggtttaccggagcccaaaaaatataataccgagtaatcaaccataagtcaagctgataatttactcttcttcatcatcatttaattctgttaattgaccttcaataccgtcaggaagcgtgtcgttatcatcatcgctagataaatcctcataagttggatcatcggcatccgcgtcatcagcggcggtaacgtcttcgtcttctgggtcgtctgcatcgtaatcaattacgtcgtcatcatcggcggcgtcagccagaaaggcgttgacccgtttacgttttttacgtaccggacgatcttcgtcttcgtcttcttcagtgtgaattagggcttcatcaattgattcaaatgggtaccatgtccgaagtccccaggtgttttcaccaagggaaataaaactgccgtcaatatttaaatcagtgtaaaattgcgataaccgattccgaaactcttcgtccgtcttttccaagtaattttgaactgcattagctaaatcaacgaatgccattggttcaccattcttagctaagatggcgtgagcaacttcgatcatcgagagttcgtctttgttttgacccttaaaaatttctaattccaactggtgcacgtcctttccacagtctgtccttaatgatactacactcaggccgtaaattgcaatcggattttatagttaccaatcagctgtttacctgctaaaagttggtaatcaatgttcacttgacctgccaacggttcgttttggagttgcacatctaacaaaggggtgaccgtttcaattgggaacagtccgtacggggtgcggtaacgcgcttcaatccgtttcccacttgcaaaccgaagccgcatttcattttcagcagctcgcgttagtaaaaccgttccttcgccgtcaattttcatggtaaccggaattttctgtccgcttttttcgtctacttcttggtaccgtaagtaaattgaattgcccatttgaaatacttgtcctggttcatcgaaaactaggtggtttttttcaccttcttgttcaataaacgtttctaaatggatcgcaattggaattccattatctagtgccatttgaatgctcctcttcctttcactttattaccataccaattataattcattttacatataattgtactattctaccgttcaacttttacaagctttagcgaaaactagtataattctaagtaaaggatttatttaataaaaatcaggaaggtggcatcatggcccttaaaaatcagcgcctgccgatggaaaaagtttttcgtgatcccatccatgattacgtttccgtccaagaccaagtaattttggatctgattaacacgaaagaattccaacggcttcgccgcattcatcagttaggaactacttcattcgtttttcacggcgcggaacacacccgtttttcacattctttgggttgttacgaagtagcccggcgcattgttgaaaactttgaacggaattacctttccaaaaaccctaacgatggattatggcgtaaagaggaacgtttggtaaccctttgcgcagcgttattacacgacattggtcacggtgcttattcacacacgtttgagcacatttttcacaccaatcacgaacaaattactacccaaatcattacggacccgactacggaagttaaccaggttttacgacaaatcagtccagattttccgacccaggttgctgccgttatcagtcacgattacccgaatcctcaagtggtgcaattgatttctagtcaaattgacgccgatcggatggactacttgcttcgggattcgtattacaccgggacaaactacggtacctttgatttaacccgtattttacgggtaatgcgtccctactcaaaagggattgcctttcaaattagcggaattcacgcggttgaagactttatcgtcagtcgttttcaaatgtacgtccaggtttactttcattccgtttcacggtccatggaagtcattctcgggcatttgcttgcccgggcacaccagctgtacttagattcagcaaccccgtggcagcaggccccacaatttttaatgccctttttcaacaagcaatttactttaagcgactacttgaaattagacgacggggtacttaacacctacttcttgcaatgggaagattcagaagaccccattttaaacgacctagctaaccgctttttaaaccggaccccgtttaaatcggcccgcatcagtaaccaaacccgcgcacttttaccagaattgaaacagttagtggctgcagcagggtttgacgcggaatactacactgccgaaaacgatagctacgatctgccgtacgacgcttatgaccctacgtcgcaaaagccccggacccaaattgaattgatgcaggccgacggttccctagtggagctttccacggctagtgatttagttcgggccatctcgggcaaagtttcaagcgacgaacggttctattttccaaaggaaatgctcactagcaacactgaaaacttgttctcagctacttttgaagcattccaatcacacatcaaaaatggcatcatcaattaggaggatgatcatgagtattaaattagtggccattgatttagatggcaccctattaaacgataataaacaactgaccgaagaaaacatcgctgccattaatgcagcttctaagatgggcgttaacattgttttgtgtaccggacgccccatcactgggattcaacgctacttagcccaacttgaactccaaaacgaaaaggagtacgccattacttataacggcgggcttgctcagaccattaacggggaaattttaattaaacacaccttaagtttccaagactacctggctgccgaagccttcagtcgccaagtgggcgttcatttccatgtggatggcaagaaccatatttacaccgccaacaaaaatattagccagtacacggttggagaaagtttcttagtagaaatgggcttacgttaccggagcgttgaagaaatgaaccctgatctagaaatgcctaaggtaatgtttatcgacgatccgaaggttttaagtaaggcccgtgaccaaatcttcaatcgtttccaagacgaatttagcgtggtccaaagtgaaccttactttattgaattaatgcctaaaaacgtcagcaagggcaacgcggttaaggagttggcggaacgtttgcaccttagccttgaccaagtaatggcgattggtgaccaaggaaacgacttgtcaatgattaagacggccggaataggggtcgcgatggaaaatggaattgacgaggtaaagaaaaatgcccagttcatcacggctaacaataatgagagcggtgtggcaaaggcaattagaaagtttgtgattaataaataagagcgctccgcacccccgggtagcccttgaggactaacggaattagggaattaatcgcgggttaggcgattggttccctaatttggttagccgcagagggctgggggctgagcgcgtttcgactacgctgcaggtaagcacctggattaactttattttggccttaatcgcgggattggcgattgaggtcaaaatttggttaaccggagaagattggtggctggaacacgtttcgactacactgcaggagaaccacggaattagggaattaatcgcgggttaggtgattggttccctaatttgttcaattggtctatcccctctcccagaaattacccaactacgttattatataatcaaattttaacattggtcgtgcacaaaaacttaagtcgatcgtacatgaaggaggttcgcttaatgggacatggctcacaatttttaaaaaaaatcttaatcatctatatagttgctaacctaatcgtaatggcacttaaagccttcactccattaggtcaaaacagcattttcaacctgcttgctttcgtgatcttgtccattttcaccgtttatttactttatttattaataaaaatgggcaagaaactataactttaaaatcaacggcatcttcatccgctagcggggggcctcccccgttttttgattactgacgttgaaatcgttctcaaactatgtataattaatgtacacgaaggaatgattatgatgaataatacggaacaattaagcatcgccgttaatgaatcagcaattcggtacgcactttttagcgaccagggtgaattgaaggtacgtaaaagcgtccccactcctactgataacattgataattttttaaaagctatttatcacattgttgaagaaaaccaaaaaaatatctacggcattggaattagcgttcctggtcaagtggatcaagcggatggaatcatctaccaaggtggttctctaccgcttcttcatggactaagtttgggcaaaattatcgctgcgcgttacgaccttcccgttgccatgcaaagcgttggaatctgtgcagcaaccgccgctcactggaatggaaacttacgtaacattcacaacggtgcagccctaatcctcgatgatggcgtaggtgctgggatcattttaaacgaccggatttttaccggcaatcacctagaagctggggctttagggatgattttagctaatccgcaaactgatgatccttcaccatcccaaattatgtttaacgcatgttctgccactaaaatggtgcaaaaaatcgggaacgttttgcaactttccgaccctaacgacgataccaaggtctttaaagccattgaaaatggcgaagccaacgctcgcgaactttttaatgagtattgccgcaacgttgcttacatgatcgccaatactcaggcagtgctggacttgaacaaatacgtgatatgcggacggatcagtacccagagcattttggttcccgaaattaaccatcagcttcaggtaattcgggacagcttctcacttttaaaagaaactctgcacatgccaaatgttgaaacttcagtttttaaacaggataccgacctttacggtgcttattactttgcattatcccaattcgattttaaaaagttacaggaagatgcagctcaggacacgtcattgccagattaatagtaattgcgtgtgccctaaatttcccttgaaattattaaaaagcgggactgaaaaaagctccaaaatccttctcaaggatgaaactttttgaaaaaacattttggtgcgttaacttgaatagagtcaaaacatccgccaaaagcccgttgattccactcaaccctaaaaagagaccattatgccaagttcaggcataatggtctcttttcagttaatacttacaaactccccaacttggggttgtacgctcatttttatttaagctcataccgatctgcaaaacgaacggtaatgacctgttcaatcatttcttcttcagtgcggtagtcttcagggtttaattgtcgtttattattttcggataaaatagcaattaacagctctaacattaaatctcggctaccggccaaatagtttaatctaggaactccattattattagctattagcaggcaagcacccgcttcgccgaaaaagtcgtctattatctcaccattttgggaaataattatgttttgcgcctcgggatgtttaattaagcattcataaatcgcattcaagtaggggattaaggtagcatcttctcccacttggtaagtatcatatccctttcgagctaaggtccgttgtaaacttatcttaaagttggaccttggtacaaaaaagaagttgtgagaaaatggtctctcttctcctaaatcaaagttaggaaaattaattaacaccgagccaccgccactaagtacgatttcgttagctccgtccattccgtggtccactaaagtggccgagtttacttggttcctatcttggtcataaaaaagcagttgttgggtttcttcgtcaaaatcccagtagtgaccttccggagggataaaccctacttttgtgggcacaataatgctaccgtcttttttgaagataaaacttgtaaaaccaactttatcgtctgcgttgccacctagatagagcactccccgatcccaagggacgtcccgatctgcaagctgccaaaaccatatcttgtcacaaattaattttctgaattcaccaattttcaacacgcttcctcctcattggtgcctagctcaacgctacaagctaaaaacactagggcttcctacttaaatacacatcgatcactaaattgttcgttgacaatctgttctgccatttcaatttccgaacgctgatcatccggatctaattgacgcaaattgtttgtgaataaaatcttaattaataactctaggactatttcacggctaccaacgcagtaatcaaacgaaaagccttctccgtagttggcaagtaatagttgatcatcctgcggggaggattcaacttccagctctccacttcgggaaatgaccacctcttcgagttcgggatggttaattaaattttcgtaagcttggttgaaaaatgctattaacgtatctgcatcatctagccaatacgtattgtatcccatccggctcagtactcgttgtttctcgatatcgtattgtgtccgtgatacaaaaaatcctctttgcgtaaccggtacgtttgtttctacgccataatcaaagaaattaaccaacattccgttgccatccgcaaagtcaattaccctagctccatacaccccaattttaggcaggccagcgaatactttggggtttcgatcctcatttaagaactcaattcgttgttgttcttcattaaagttccaataaataaattctggaggtacgaatcctatcttagtaggaaagtcaactttaccgtctttcgtaaactctaatgcaacaaagctaaagccttggtcttcaccagatcccaaaaaaaattctgcgggcctttcatggtagtttacgtttaccgtatcccaaacctttcaaatccataatttaccgcaaataagattttttaatgtatgtttatccaaggtgaacccccttacttatgcttaaaccacgcactactctgttcttgaaatcccttgaaaacggtagtaactttccggccatgaaccaggcggtccgcaaagtaacgatacgccacgtaattgccaatttccatttcaaatggcccaagtccagcatgttcgtcaccttggtgcacttttaattgttcgtcagtaattagttttaccataattcctaggtattcaattaatacctcgcgagttcccccaattactccaatgtttaaaagggtgcgtaaggcatttttagcactaaattctttcatatactgaggtgaagcgttattagctacaatatccacatcgcctaaccgcttccattcgtcaccaatgtatagaataccgtcttcgatttcgtcaaaggggtaatttagcataaccacgtcttttgcatctgttaaaactaccttttcaatttctggatgggcttgcaaaaagtcgtacgccattaaaaagcggtaaaagtagagagtcaagtttggataatgttcaaaaagtttcatattcacgatatgtaaattatcttcgtctccaccttctgaactattagtgaggacgtaaaatggcactccataacgcgctaaagaggcagtttgttcctgaacctcttctgcaatattaacattttgattttcatacagatgaaaaatattgtccatattcacgataaactcggtaatgactacgtttggttcaactttcattagcaattgctccttcactttatacgtcggttatatataaatcaatttgacgccgttaactataacaagtataaacatatttccaacgcctgtctacttgagagtggataaaagttgcgtaatttaaggttaaatttcccattacgcctgattacgacgctaatttcagattttaagttaactggaacaaccgggaacctaaagcgttggaccactaaaaaataccccaagtccactaacagcaattttgccatcattaaacttggggtatttaaaattttgtacaaccattatgctaactaagccaccgcatgttgccgttgactatgtgccaaaaaggccagccgcataattactaagttcaacttctcttctaactttgcatccacccgtaaatatttgcttacacaattatccacttgttgatacaatttggtttccttcaacgcttgatcacttgcaccataacaatgattgtagttttggtccagttcttcttgttcaagcacgtcaggaaagtcggtctgggttcccggaccgtcatagtaatccactagattaatattggtgtttatactcaagaaaaattctttcttaggagttcttaacagctcaaatcccagctcggtatggttatcagtgctgataactaagccttcatcatcattcagcggtaaaaagacgaagtaatcgtgccggttgctgctccgaacgtcgtattccactccgtttaatcccgcgatttttttgatgcagctgtctttattgatttcaatcgttttatcttcttgcattactttagataaaacatcatatttaaaaatcatttttcttcctccaaaaaataaccataaatactggaacagaagaaattatactccgcgcatttaaaaaatcaaccgttgtaatctgaatgtaaaatatgtttttcatccgccggctttttcttaaactagcgctaatctacctagttatttaaccggcttacttgcggggttttggtcaaagtataccgccatcaaaaaacgcagcaacgtcaagttaagtttctgggcatcttcgccttcaaagcctaaataatcccctagataacggtcggtcatttcatacgtggtcccgtgcatgatttcttcgtcactagcatggtggtacttccggctaaattcgccaattgacggaccagtgaataaatctaaaaagtcggtttcgttacccacgccgtcttcaattccaattacgcccttatcaacatcaacgtcaaaataaaactcacttaatggaatttgaaaaacgctaaaaccatcaaaggtgttgccatcggaagaaaacacaatccccttccccggattcaactccaagaaacaatagtattcatgctcatttttaattttcgagacaaatttaattgcggcgattttatccgccattaatttttgtatttgactttgttcattaatgataattggttttcccgtgctaattacgtcctttaatacgtcatacgtgaaaatcattaaccaaacccccttctctacactcacaacctactaactttattatagtgccctggcactttaaaaaacactttatgcttcaggttcccgtcttaattgacgaacaacttggacataggaccagatcaacactaaatttgatcctagccaagctaacgggtttgccgtgcaggctccgataaagccaaaggcaggtactacccaaattcccactaacatccgggaaagcaattctgcgacccctgctaacgtaggtgccatactcttcccaaatccttgtagggtgtatcgcacaataaacaggattgccaacaggaagtaactcatgctgacaattacgaaatattggtgtgccaaattagtaatgtgttgttctgaatttccgataaacaggttaactaacgtccgactatttaagataatcaaaattcccatcacgaaaccataactaatcgacgtagttaacgcttggcgaatcccctttaatatccgtttgtattgcttagcaccgaagttttgcgcggtgaaagtcgccatcgtaattcctaatgacatcattggttgagttgccaattggtccacttttccggcagcggtgtacgctgcaattgctgatgaacccaagtggtttaacgaaatttgtaaaataatcgagccaattgcgatgattgaagcttggaatcccattggtaaaccaatccgaatttgttctttaattaacgtccaattcgtagtgatttcccgccattcgagggacaacgccggaacccgagccttaatataaaaccaacatagaaaacaagaaatcaattgggccgtaaccgtagcaatccctgcaccagcaattccaacgtgcatgaaaacaatcaagatgatgtccaaaactacgttaataatgcaggcaatcaccaagaaaatcagtggcaaacgactatttcctaacgcccgaagcatattggaaaataggttaaaaaacatagttgccactagtccgccaaagataatggataagaaaattgcggctccatcaataatgttagccggtgtctgcattaaccgtagtaacggtcgggttgcccaaacgctaagcggggtgagcaacaataccaatccgccacaaatccaaatgctagttgcaaaactttgtttgaccgctcgtaaatcccccgcgccatagtgctgggcagtgataatcgataacccggtcgtcatcccctgggcaaacccaatgatcaaaaaggtcagcccactggtagcccctaccgcagctagggcttgtaccccgaccacccggccaacaatcaaggtgtcggagagggtgtaaatttgttggaaaatattacctaaaagcagcggaatactgaataagataattcccttaattgggcttcctttagttaaaatactatccatattaatcctccgtagccgttataaaaatgaaataaaattatttatgatgtggagcgtgatgctatatttgatatccttggtccataaataggtgatcgctagcagcattcccatgattgcgtaaattgggaaactagcgcctaggtcgtgcaatccgccaaaaagagcgccgttaactaccacgccaattgtgcgtaccagccgactatttttggtaaaaaagaactcaaaaaagaggccccggaaaatcagttcttcaataaccggagcaactagtactgcgtcaacccacgtccaaattggcgtgtcccgtagtaattgttcaatcgccgattggttttccgaagtaccaatattaaagtaggttacgtaccaagtctgcaaaagcataaaaatgaaccataacccaaccattaataacataatccgaaaacgcttactgttcaacgggtaattagcgaaatcactatgatttttgcgcactttataacggtaaaattgaaccaaaaaaatcaccactgctagagtggtcaaagtgtacactaccaccaaaaggacgtgtacaactggatgggagtcgtgaatatgcattgccgctatttgcggtaatgaaattacttgatccatcgcaaaaagtaaaactagaaacagacaatttttaataacgttaagacctttcagaagaaactcctccttagccttagttgaattattcagcttgaaagatgatagtcgctttatctttaaaatgcaattaataactccactaagtttaatatatttaagaaaatatttttttatttaagatgtgctaaattctgagcaaattttgcccctctttggcctcctcatggtagccttatagaagtgagggaggatgatgcgtaatgattatcaacgatccgaatatgcgcgagtatttggaagtccaacttatcggacacgaaaataataagatcaaagcccggacgcggaccggtgaatacatatttgtttaccccaccgcccgccaagcacgcgacccattattttggcaatgcttgaaggacatcatcaacaacaaactgtggctaccgatcacaaaacaatttcaccatttgttagaaaacgactggttggtaccttcaatgtaaaactagataaacaacagaggttgagaaaattgcttaattttctcaacctcttttttagggctgtttcgtagctaatatggcttcctgctccaccgcccatttaattgcaaatctatttctttgaccgttgcacaatgtctaaaagttgttcgggcttttgcaacacgtattctgcctctgagaaatcattagtcggaatggcaccccagccggcgttagcaaagtctactcccgctgcgtgggctgcctgcatatcaaataacgaatctcctacatacaatacatcctttaaatccatttctgcaaagtattttttgatcccaaataaaatcggatcaggatttggcttatgtttttgtgtatcgtcagaaaagaccacccgtttaatctgttgaatcttagggaaatgcttcatctcgtcatcaaagactcgttttaatttggaagtaacaatcccatactccacaccaagttcatgcaaaccggtaaacattgcctcaattccgtcgtatggtttaatcaaatcgacttctttaccaatttgttcattaaagattgcgatggtcttttccggattaggagcacccaattgtttagccatctctaaaccagggattcccattagactaataattgcctctggggtaaccgtcacgccgtcttgtttcagagcgtagcttaatgccaccaccgaagcgtcttcagtttttaataaggtgttgtctaagtcaaacaatactactttatacatcatcgttatccttccactcattgtgattttacatttatactacgccgtttgcccgtagataaaaagggaaaatcgctttcaaatccactttttttacttttatttacccaattgagcaaaaaagatgtattcgatttcatttttttatacaattaccttattttttgtaacctttctcacctagcagtcccggaaagcctcgccgcaagctttcgttattatgctatgataaaggtgaaaaacaaacggggtggacaatatgaaaattgctttaatcggcgcgggtccgcgcaacttaatggccctcgaacgtttagtttgttggggaatcagtaccaattactcagccaatgtcgaaatatcactatttgatcccttcggaattggtggtcgagtttggaatcctgaccaaaaccacgaactgaaaatgaattcgttagccgaaaaaatcactttattcacggatcaatctattgaaatggctggcccggttcatgaaggtccaagtttacttgactgggccctagcaaacggacgcagctttattgaagaacaccaatatcatcatcaaaagctgctcttaaatgaattagcgaacttaaacaagcactcttacagttctcgagccctttttggcatctaccaacagtggttttacgaacaaattattaatcatttaccggataactttagcgtgaccctacgtccagaatgggtgactaaagttaaaaaagatgcccagcaatacacagtcatcacccaagatgctgcttacaacgtggacgttgtgtccgctgctttaggggaaggcaacaacccgttaagcaaagaagaacggcagttgcaagattttgccgctactcatcaactaaagtacgttccgattgcgtatccagccgaaatggacgttgacgacgtagctgctagcgatcacgtgattattcgtggattagggctaagttttatcgactaccttgccgaacttaccgaacggcgtggcggaaccttccaccgcgacgaacacgggaacttaacttacacgcgttctggtgatgagcctacgatttacgctagctcccggaggggattgccctatcatgctcgggggctagaccaaaaggcagtgggtgagacttttccacgctatttcctaagtgaccaatacgttgacgaccttgttcgccaacaccaagtcattagcggcgaagaatttattaatcgcattcaatgggacgttgagttaacctactacgttaccctcgcgcaaaatagttatcctgaaattgatctaactgcttttgaagccgacctagctgctagcacaaagggattcaagaaaatcttggataactacggcattgctgctaaagatcgtctcaactgggaagaatggaagaatccgattcctaaagacgttaacgacgctgccagctttacccagtttattaagacttacttgcagcaagacgtggacttggcaaacgaaggtaacttaaccgccccatttacaagcgctattgaaaagctacgcgaattacgtaccaacattcggaaagtggttacctaccgtttaattagtgctgacgactacgtagagcaagttctcaagcattttaattccctaaatagcttcttagcggtcggaccgccagcatttcggattgaacagattttggcccttattaagtcgggcattttaactctgattggcccggatatgagggttgaaacgagtgatgatcaatttatgacttattcaaaccggcttgcggatcatcaacagtactttggtaacgtcttgattgaaggtcgcttaccccagcctaacgctgccaacaacactaacccgttggtaaataacttgctgcaacagggactggcccggatcttcaccctccagcttcgcgatggttctagttaccaaaccggagccttagacgttacggacgacactgctgaactgatcgatcaaaacggcaacgtggtaccccacttctttgtttggggtcttcccaccgaaaaacggcattggctaactaacggggctccaattcctggagttaacgatgtgcggctccgaattgccgatcgaattgcggcccaaatatttgctaaataaactggatattttaatgttgaaaagggacctcggatttctgcttgaaatctgaggccccttttttagttcattggtcgttaaatacaaatacttttctgccgcgtagtcgaaacgggttttgaaacccagccctctccggctaaccaaattaaggggatcaatcgccaaaatcgcgattaatccccttaattccgttagtcctcaagagctacccgggtttcaaaaccctctatattaatattgtcccccatgaatctccgccacattggtcgttaaaatgaacgccttggggtcaatttccctaattctttcaataattcggtgatattcggcattttccaccaccagcattagcatccggcggttatctcccgaaaatcctccctgcacgttcaaactcgtgtaactttgatccagcgactccgagataatttcctcgacctcactaagtcggctactcataatgtaaacactcttcttccggtcaattccggtctcaatataattcatcactaacagcgtgatcaccgatgaaaatagcgctaggatgaaagcttccattcccgaactaaagatattcatcagacaaacaatcgtatcaagcaccagcaaactcacggaagttttaaagttaaagtacttttttaaaatcaacggcggtaccgtagtgcccccgctggaagcatcaatttggtataacagcgccactccaattgcgtacagcgctccgccgacaatcactgccaacgtgcggtccgataccaagcttaaactcggcgtcaccgccatacagactggtaacaacaaactgcccaccgtaattcgggccgtagtctgttttcccaatgtaaagtacgacgctatcagcattgccacgttaatgataaagacaatcagcgcccggttccagccaaaggcgtcctctaacaaaattgaaatccccgttgcgcctcccgcagccacgttatgtggtgcgtaaaacatgttaatgctaatcgctaaaacttctagcgcgactaacatgatggcaaactggctgaccaaccgaaaacttttctcgcgcatctatttatcccccgttcccttaaactagttatctaaaaagagtgggtaaacgctcgactagctttcaattccgctctcgcaattttgcaaaagcagtcgtcagtcacaaaattccaaaatcaattttcaaagtcgcgacgttcggctccccagctccgattctctttctattatacctaaaagttattaattattcttgatataagttttcaaatcagatggttttaactgttgccaatcttcatcaaagaattgatgcttaatttggtaatgcgttgattggctaggttggtcaacaaaattcttgacgttttgatcaaccacgtaccaaccgtaccagcctaaatggatggtatcttgcatgaaatatttcttaccgccatcgcgtgataaatcgaggatctgattgaatccttgactttgcagctggtaatttatttttttgtcaaagccacggagcatttcttgtgataagtccacgtaatccgcccacttctggttaaccggcgggatgataaagagcacttgggtatgatttttcgcaaattgatccaaaattagctggaagtcagcaaattcaggcgaacgcgtataatcgtaatgcttttgcatcccttcaaaagcagcaatccgtttcttcaaacgtttattataaaactggttttgaatcccaaactggttgtttgacgtttgccgtttagcttgacgggtcaaagcttgttgaatcatcccatccgacgggctattaggtaatgcttcgacctgccggttaatatggtcctgattagttccttgcaagctaagcggcgaaaagagttggtcttcatgagccaacaaccgtttatagtacttcaagtaagtccgttgtcccgaagttacctgctgcccgttagccacccgatctaacgcattaattacttgacggttagtgctgttactccggtcgtctaacatggttagcaaccgtttagcagcgtatcgttcacttggctttccagtttggttttccaagaagttaacggcttgcaattgcgagaagtaaaatgcaaaggcatgcgggtcagccccttttcttacaaaccactgtggtgaaatcacaaagacggcctttttattttttagttggggattaattccctgcatttcaaaataatgggtcaacgattgggtccccggtgctcctagtaaaaatggacggaagtcccaatcatacttttccgccattacggatggatgggctaaatcaaaccgggaaagttctgaagacccaaaaaagggaacgtaattcccattttctaaggcggcccgttttacggcatctcctttgagcgtgtctggggacaatgccgtagctgctttttgctcaacggctgagttaatcttatttattttgaatggggaaaataaaagtccgattaaaatcagcgctgccgctaaaacggggccaaaaatcatccataaccttttagccacgagcttgaagttcctttactttagcaatgattttatttggggtgtcccattcgctacgttcaaattcagatacgggaacttcaattcctagttcagtttgtaattgcaacaataattgaaccgtgcccattgaatccaatagacctgcgtcaaaaaggttatcatccatactgtcgctaacgtccgtaccaattaaatctgtcaaaatatttaaaactgtttcttttacgtccataattaattaacctcctttagtatttaacaaaaaatagtttatctaggaatcctgagaaaactaggaaagtgaagcacacgaaattaaaggtaatgaagatcgaaagtgcttctgtccaccggttatgcggcaagcgtcccggattctttttcttaaatccaagccaccagtcgttgattacgagggcgaccccatgaatcaaaccatagaggatgtaataccaggtttccccatgccaaaatcccattaacaacatgtttaaaacgtaagttacgtttgccgtcgtcttaggactcttaaaggtcttgtgcttcatgaagaaaaacacgagccgcatgtaaacataatcacggaaccagaatgacaaggtaatgtgccaacgattccagaattctttgatgttgtgcgatttgaacggttgcttgaagttcatcggagtttcgacccccatgaagtagctaatggctaccgcgaacaaactataacccgcaaaatcaaagaataggtaaaaactgtaaacgtacattacgcccagcaggccccaagagagaccgtccgtttgtaaagcaatgtgttggacccttggcaaaagcaaggaaccaaatacgtaagacagcataaatttatacacaaaccctaagaaaaggtagtgcacacccttttccaacaggtccaagtagtgtccccgttcagggacgtttaaataatccttcttaaagcgccggtaccggtcaattggcccagaagaaattgtcgggaagaaggccaaaaactgcaggaagaaccacggatcgtaatccttcaagaccccgtcgcgaatttccatgatggtctgaaccgccttgaaagttaggtaactaattccgaggaatccgattaacgaagagttacctgattgcaataacggcgtcattttgaccactgctaggggcaaaattgccagtattacggcccctacgaaaactccggtcgcgttatgctgcttgcgatagcggttatatagtgaaaccaatatcacctggaagattaaataaccaattaaggcaatcccctgttgccactttggtcccccaaaggttagcaacaagaagaaaaacgatactaacagttcgtaccagtgaaaacggcgtccccgtagcatcccaatcacaatgggcactagggcaatggctaacatgaaaaagtaagtcgggttttcgtaaggtgtcgctgtccacatcatgagttaacccgcgcgatcatactttttatgtcaatcttgccgttcgccgtttgtggcaattcttcaacaaaaataaaccggttcgggaccatgtattccatcatgttagccttcaaactgtccttaatggccaccgtgagtttaatttgtgaatcatattcatccgttgccggaattacgtacgcgactagttgcgcaactttttggtctttaccgtacttaggcacggcaattcccgccttgatgagcgggtcgttgttcaaataatggttaacctcttcaagttcaatccggtaaccgtgtaatttaatttggaaatcagttcgaccacggtagtagaggaccccatcttgatccattaccaccaaatcaccggtcttgtatgccggatgcccttcatacttgaagaagacttcgttagttttggttggattattaatgtaaccctttgaaaccgctggaccataaattaccaattcaccttcgttaccagctttaacgacgttgttatccatatcgatgatgtaaccacccatgtccggtttcaaccggccgattggtaaccggtcgttttgttccagcacggcgtccgtaatttcgattgccgaaaccgcaactgttgattccgtcgggccgtacgtgttaaaaatccgcgcttctggaaaacgttgttttaaagcttgggccgtcgcatgtgacaactcttcaccacagaacaagaaccgggatagtgccggatagtgatccgcatcaaaagttggttgcaataggcatacgtccatgaaagatggcgttgaaacccagacgtttaaccctaacgttggtaaaatttcgaaaagttccttgaaattatcggtaaccgtcttaggaaccgcctttaaagttcctcctaacaccaaagtagcgtataggtccattaccgataaatcaaacgaatatggtggttgcgacaaggttaccggacggtcaggtaaatcgaactggtccatttgccagttaacaaagcttaatagattgttatgactgatttgaactccctttggtttacccgtggttcccgaagtgaaaataatgtagtagttttcatctccagtgaccgcctgatctagctctacgctttgcgaatctgcaaacacgtctgaaagctcctggccttccaaaatcggcaagtcatctaaagagaccggtaagtcttcaatggcaatacacatcccgggatgcgcaatctcattgatcatggttaaccgttctggattagaatgccggtcaattggaacgtaagcatgaccgcttttaactgctcctaaaaaggccgccaccatttcaaatgtttgtcccccataaatcataatgggagcttgttccataatattttgttctaaaatgtaagccgctaaattatctgagaaagcttttaattcaccatatgtgtgcgtatttcccaaataatcataagcaatccagtccggatgctcttgggcaattgaatcaatcttttcaattacgtttgtaactttttgcaaatcaaaacctcctgctaaaattcgttgtaaatgaaagtcccgccagacattccactatacccgtataaataaagtaaaatcacaaaaactaaaaagtaaaatactgtccttgtgatgaatttaaccaaatcgtgttgccacagattcttaagaaaaccgatcaccacaatcccccctgttttttgctattggtttagtctgcaaaggttgcgttaggtcgctaaccctgctaaacgttacgcaaaattatggcatgatttgaattttttgtaaagtaaccgtaacattacgggcttaaaaagttcacatttgtcacattctattcataaattatctgccgattatttccgtcgttacggcgtttatcaaatttatctcataaaagtttaaaaaaagctaaaatttagcctccgggagctggtcttgactaaattttagctttgtagcgtctattttatttttaagcgtcggcccactaaagccactaacgcagacttaatgacgtctccaggaatgaaaaaggcgtttgcaagcaccgccttagaaaatgccatccgcatattaattgcaaattcaacaattcccaataaatcaattactagaaccgcaatgatggcaacttttgcaaagaggccaaaccaatcttgtcgaccgtgtgacgtccaccatgccaataatactgctcctacaagataccccaataggtaaccgcccgtcggtcccataaatacggctactccgccccgcattccggttaagactggcatgcctatcaaggccagtagcagaaacgcgccgatggtgattgcggcttctcctggagtaaggattaaccccactaataaaattccaatattttgcaccgtgatgggaaccggaatcaatcccattggaagattaggaaccaatcccaacccaatgataattgccagtaataatgccatttttgttatacttcgcgcgtcaagccgcataaacttcacctctaaatttggccttccaaccgaacagttgaattaccttattccaaaaatgttgtttatcaaccatttttgatgaagctttattatagcatgttgcgcattagctgctattttcggttaccgttaaccgatattatatatgtagtaatttttgaaattaggactgtcgcgagcctaatctccgtggtttagcgaactggctaacccgcgttctggaacccagctctctccggttaaccaaaacagggaccaatcgccaaaaccgtgattagttccccaattccgttagtcctttgtgttctgttgctgcatggtcgaaacgcgttctggaacccagctctctccggttaaccaaaacagggaccaatcacctaaaccgcgattagtccctgtttctgttaatcctttgtgttctgttgctgcacagtcgaaacgagttccagccaccaattttctccggttaactatattttggcctcaatcgcctaaaccgcgattaaggccaaaatcaagttaatcctcaaaaattacccggtggcttccactctctttatttttctccccttctcactatcggcatcagcctaaagtacagtaatccaattactgctcctactatgattccctttaaaatgttgaacggtagcaccccgtacaacaccatatttaacgtcgagatatttatttggaaacttgccaatttcatatacagtggtaacaaaacaaacagatttgccacactcatcaccacggtcatcaaggccgttcctaacagcactcccttaactagcgccactacagcttggtgatgcggctgatcttctgcgcgtttcaaaaacgaatagattggtagaacgtacgctaccgccgccatccaatttgctaccgctccgagggctcccgccgggttgctatcccgaacaataatgtccaatagcccagctaatccagccgtcgccattccccacacgggcccaaacaaaacggttccgatcaagaccggtacgtccgcaaagtcaatctttaagaacgaaaaccccggtaaaatcggaaaatcaatgaaaatcaacacaaacgaaatggctgccagcattgcgacaatcaccatcttattaactttagaaacactcatgttactgcctcctttagaatcggagcaccttcttggtaacttatttccacaaaaaaacgccgttgctcgagttcggggcaacagcgttaaaaaccgaattaaaaaattcagtgcgcgtcaataaattcaatctccctttatctagactttaactatcggtttcggaatttcaccgaatcagctgtcaaaaatgacaggtcatggactgtaccaccggtcgggaattacaccctgccccttgaagatgaaccttattttttataagtatttcactataaatatagcctactaattaatcttcgtcaatcatttgtttttttgattttgaaatagctttcaccgtcttgcatcacgtctatcagcaggtgttcttccgcaggtaagttcttcacttcacccaagtcgatttcatagccgttttcaatttcgtagcccttgtttacccgggactgcaaaaaaattcgtaacattttcattaacttacgattgtcctcggcttttttagctgccatcgctaacgtataccccttattaaggtaatgggcaatgtttccggcttgaataagtgcagggtacgtatatttacgctggcccgactctgatacattggtctttacgtagcctttcttttcccaataacgcaattgacgaggtgacacatcaattgcctttgccacatcgccaatacttagtaacaaagactcgctcgcaatgatcctttttaacatatcgacccgatctgacggatttcccatgattctcctcctgaagttaacctgattgactttgtccgtttatttaatttaattataacttctctaacatatttgtcaaataagttgacaaagatggtataccggactatagtatctaagaatagtttttatgaaaagaggttgtaagcttatgacacaagcatttgatgcacatggaaaaccctataagcggtctttattgatccttgtgcttttaattggttcattttgtaccgttttgaaccaaaccattttaaccacggcttttcctactttaatgaaggccttcgatatcagtacctcgactgtgcaatggctcacgactggtttcttgatggtcaacggaatcatgattcccattagcgcctggttgactagccggattccttccaagcggctatacctttcagccatgacgatatttttaattgggaccacgttctgttacgtagccccttcgttttcagtactccttgctggacgactaatccaagcgctaggggtcggaattacgatgccccttttgcaaaccatgatgctaaccattttccccgctaaccaacgtggttcagcgatgggacttgccggcctagttgtcggggtggctccagcaattggaccgaccctttctggatgggtcattgataactaccactggcggactttatttgggatgattattccaatcgtcattgtagttttaattgctggtttcttctttatgaaagacgttttgaaaacggagcatacccaactcgattggatttcagctgcactttcaaccattggttttggtagcttgctctttggcttctccgaagttggtgacaagggctggactgattccttagttgtagctaccttaattatcggggcaatcttcgtaatcctatttggggcgcgtcaattacggagtaaaaatccgttccttgacctacgggtattgaagattcctgaattttcaatttcagcaacccttagttcggtttctatgattgccatggtcggtgcagaaatggttcttcctctttacatccaaactgtacgtggcgaatctgcctttcattctggattaacgttattgcctggggcattaatgatgggggttcttagcccgattaccggacgtctcttcgatagaattggggcacgccggttagcgactaccgggatgttcttgttaacaatcggaacgttaccatttgctttcatcacccggaccactccaatgctttacatcatcgtgttatatgcgattcggatggctggaatctcaatggcaatgatgccggttactactgccggaatgaactcgttgccatttgacaagatggggcacggaaccgcggttaacaacacccttcggcaagttgctagttcgatgggaactgccattttagtcagtgtgctaaccaacgttactaacaaccaaatgcctgctaaacacttattgaaagctgaaccactcgcttacaaagaccaagcctttaatgccactatcagtggttaccacgcatcgttttggatcgcggttggcttcagtgccttaggtctaatcattgccttctttgttagcaaccgttctggtagttcagccgaagtacaacctcaagctggaggtgaaaaataatgattatttttctactaatacttgctgtgatcgcaacctttgtttcaatgaccctaattcccaaacccgtggttcgttacatctgtaccgcaatttctgccatcgtggtcgttggctcagtagcgctattggtaatgaacgaccgggaacatttcgggatgaagaaaatcaccgaaacaaccacccaaaccgtttattcagtttcaccttcaaaacaaatgcccatgttactttataagaatattgggaccgatggtaaggaacgagtttacgtttataaaaaggatgcggacaaaaagaaaacttcccacaccgaattggaaaaaactactaaccgggttaagaccactaacgacgaccaagctcgtttagagaagaaaaccacccgttgggtatacaaaaatgatacctaccgcctttggtttggaatcgccgggaacgaccgggaagtttcccaccgggttaacaccttctacgtgcctaaaaattggccaaccttgtcaactaccgaagccgctaaattgcaaaaattggttaaacaaaatcaaacttcgatgaaaaaggatgctactaagtacgtaaaagctaaggtaaccgcaacggttaaggacaccttaaaagctgctttgcagaaaaatccccggatgagtcctgccgaacagaaaaagttgactgacaagacaactgctgaagctaccaagaagtttagtgctgagtaccaagcacaaatgatgcaaaaactaattgaacaagctaaaaagtagtttagctaccgatcaaaaaagcttcccaagaattccgattcttgcgaagctttttcatttattgatttcaaagaccatcgtggttaattattgggtttacaagtccgttaggcccctttaaaagtcgctgtcgccgttttagcgcaactactggagaaagaccgctcataaaatttaccttgcttatttagtctcgtaagcttgcaactgttgacttacccaatttgtcgcctgggctgccgtatcacccgcgtgaatggcgcaaaaccttgcgtaaaattgttcgaattggggacttagctgttgctgagtttccttagcgagttgagctaattcatgagtcagttcgccttcgttgtaaacaatcttgcccggtaaatctttttgatagtccagataaaatccacgaagctcgtcgcgataagtttcataatcatatggaaagaacacaatgggccgttttaagtatgcataatcaaagaaaacgctggagtaatccgtaaccaacacgtccgcagctaagtacaaatccgcaacgtccgggtaattcgatacatcaattgcgaagtcttctacaccagtaagatccaccgcgttagcaatcaaatagtgcatccgtaaaagcaaaattgtatcctctccaagcgcagcccgtaatttttccaaatcaaacggtaggctaaaagcatactttcccttggtgaaaaattggttatcccgataagttggtgcgtataagaccacctttttatccaggggaatccctagcttttctttaagctgccgaattttagctgcgctgggatgcgctaattcgtcattgcgggggtaaccaatttccaaaatttcgttttggtaaccaaaagcttggcgaaaaattttcgtagaataggcgttaggactgattaatgcatcccaccggtttgcttcatgaacaaaattttcgtgatatttttccgtagtggtcccgggcatggttacttgtgcaatatccaagcccaactttttcaacggcgtaccatgccaagtttgtagtattttaacgtgcgccggctttttcacccaacgaggcaaccgggcattttcaacccagacgtgcgctttttcaatcgtacgcacccatttaaaagatccccgaaccacataatcgtaacgttctccattcggaaacccgtcttcaaccagttgcttattcaccacccagatcaaacgataatcgggatgttcttttttcatttctttataaattgctaacggcgagtcactaacttgtcgccctccaaagctttcaaaaataacggtgggccgttttgcgggccggtagttaattttgaaggcgtaggttaggaggcggcgtttgactttccgcaaaattgtaatcatatccatttacatttatcccctattttataattgtttatgtccattataggacagattttagacatcaaaaatagtacattactcgtttatctgcgctgttttaaaatattgattggtcaatttatcaactgcttgttttaatttttggccctttattttattgccttgatgattgctaaatacgatgagggcttgtttaccatccggactaattcgaatatggtcttcaaatccgtagccgtaaccattagccgagtaataattttgttgattagtgtacagacctccatgatatttgacttgagccccgttagccggtcgatacaatgtttgcacagtgggtttgcctaggagtccaccattaagtaatttagctaatgttttataataatccgcaacggacatgtacacttgtcccgtgcctaattctgattcaaccgtcgccaagttaggcttttgaagcacttgtttaacttcgtccccttgttttttgagataataccccttagccgtatcataaccagtagtgtcagttgcgaatacggtttgctgtaagtttaacttgcttgtgtaacgttctgtgaatagctgttggtaactatcccccgtaactttttctaaaatcattgacaatagcacgtaattgacgggctgataattccatttaccatatttttccggctgaaatttaacgttctttcgaagaatttttaaatactgttttctagataaactatcacctttatatttaagcttaggcaatgataatcccgatgtcatgtcgagtagctgtcgaatggtgatttccgcagaacccggtatgcccgttatgtactgattaaggcgatccgtaagggcgatttcatgcctattaaccaaggtcattactagtccagccgtgagtgatttttgcaaagaatcaatttcataagcagtagttaaccgattctttttgccaccttcattatcttccactcccgctgtgtaactatcaacaatttggttgttctttactaaaattgctgagccactaaatccggttggtgaaagtgcttgctgcaaccttcccctttccgtcgagtgagtcgctcgtggaatcgccaaatgattatttttttcagtagcggcgggcttttttaagtatgtacttgcctgcccccaaactattatcaatgcgagaacgattaatccaccgataaccaacttattaatcaatttttttgacatttcgatttctcccccaaataagtttaccagatatagttttacactaaatgtcgttaaagaactagctttaaagggaaaattaagtataagcttaaatattagcaataggaggttaaagatttagttttttaggtatataaaaaaggcatgagttattaactccgccttcttaaatgtaactattatagtggttattgattcccaattacaatcgaataaaattgctgtaaagcttcatcgttatatttcttgtgattgaaattagacgcctttatttcaccgttaataaatttatccattccttttgcaattccatctattgtattttcgactaataaacctgctgttccactaatcactgaatgtattcctggtacgtctgtaccaataatcggcttttctagtagcattgcttctataattgatagtccttgtccttcataattggagggtagaataaaacaatccgttaattctgtcagcatagccggtttagacacatagccggttaaggatatatattcagacaaccccagatcgtatattaaatcttccagttgtcttctcaagggaccatttccgacaatatataaatgaacttgtttgttctttgcgactatcttttcaaaagctttaatcaaattaatttgatttttctctggagataaacgggctacattaataaaattaattttatcttctgcaggcttaataaaactcttctcagttaagataccaccccaattaactgactcatcaaaaacaatccggtattgctgatcgtaccgtgatttttgtaggccctctaattgctcatgtactaactgcttttgttctaaaactcccttagcatctactacattatttacgtaaaccattttagaaagatcgcggatccatggttttaaattttgtttattttgatcattaacactctcggaaactgatacgatttcatcaaaataattgtacatactaaaggtgacttttagattccagcgatgtttgtacttgccattaattaccttgttatactcaccaagcatgtcattatggagatatactacttttcgtttaaatggggccgccgcagttatcgcggtaaacatcttattatatccaccaaaatctataactacatcgggttcaaaattaccaagaattcgtctaacttcatatgcaatttgtttttgatacttcttcatactaccaaactttgtattcgccccttgacggtaaatccaattttggttgtaagtatcacttaaatctcgaatagtatttgagaatttataaataaaatgtgccttgggatttacacgcatgatattgccggctttttcagcattaatctttgaaaaatcccaaaaaattagttcatacttatcataatcaatgtaattagaaaggttgattgctgagattgtaattccattgttgtaaaaaccaccagcatacatcattatcttctttttaccagactcgtaacttatggcgtccttgccctcttgatcaaaaatggcctttacagcacgcttacgcgcttttccatcatctaaatataaatatttttgccagaacttttcgtacttagttgcgtattcttgcaaatatacggattggtttcccgctagagcaacaccaatctcatctaagttttcagacaccaatcctggtaaagtatctaagtccatgtaaaagccccgtgcttttgcatacgcttctttatctggaatataaaaatataccgggcgctttaatggtaagaagtcaaagaaaatactagagtaatccgtaatcaaaatatcaacggcgctaagcaattcgtttgtatcaatccaatttggtagtacctgatcgccaaaaccttcttttacaaaaaagtcatatacaaaataatgtgtttttaacagtactttgtaatcttctccaactttttgttgcaagctttgcatttgatttatcaattgttgaagatcttctacagtagtatcttctatatcctttttccacgttggcgcaaacaaaacaatctttttttcgcctagttgatacttttggcggatttttttagcatcgtcgaaactcaaatcaaccctggcatttccagtcacgtaaacttgagctggcagaattccatttaaatcatgactggttatcaaccggtcagccgtgaatttgttaggcatgagtaatttatctgcttgtaataaattacgttgaatatttttgtgatccgcccagccactaccctttatatctaatcctaacgtcttcaaaggggtgccgtgccaggtattcacatacgtttgccccttttgtttaatgaaatagggcataaaagaagtgtcgttaattaatatttcacaactagccaataaccgatagtattctttactttcatgttttacaaagtgtagtttactatcaggaaattctttttttaagcaatccatcatcgggtctttatcgaccgcatacacccaataaaaatcatagtcaggtttactttttactagttctgtaaaaattgcataaacgttccccgtcatacttactgcatgataggactccagtaaaacactatttttcttaatgctattcttttttaattggtgatagtaatatgcattctctctaacccgcgaattcgaaatgtattccctaatcggtcgaacaagaaactttacccgctttttaaaatcttttaacttactgcccactttttaatactcctcctgcttctcctacgtctttagggcccttaccggaataattaacgctagcccttagtaattactctatgtgttggatgtagtaaagttgtgggatgctgtaccgaattagtaattgaatgtcccgatatgttaactaggcaaaagaacgccattaatagaatggcacaccataacacagctttagtactagtagtcattttttcaggcaaaatttgaccatacattgctttattgactattttctcagcttttgccctattaacttgttcgttttctaatgtttgttcaataagtgttctcttgtattcttcaatatcaaaatcagcctgctcttgcttcttctttgcttgatattcacgtctttcagcagagcttttcttcttaaagtcttttgagaaggttctgtaatgatcaacgatttcctttgtatccccaatttctcgtaaatcgccgtaatgcatccaagctactcgatcacaaattttttcgacttgaccaagagagtggcttacaaatattatcgtctttccttgttttttaaattcaataattttattaacacatttttgataaaaagtgtcatcaccaacggataaggcctcatcaattatgatgatatcggggttaatatgcacggcaatcgcgaagcctaaacgagaacgcatcccagtggaataatctttaactggttgatcaataaaattaccaatatccgcaaaatcaataatgctgctcttaaggtcttcaatctcttgaatacttaacccttgcattagcccctttagccggatattttctgctcccgttaaatttcttttaagacctgctccaattgcaataatcgaggtatcccctctaacttctacagatcccgtagtttgagggataatacctgaaataatatttgataaagtcgactttcctgaaccattaattccaatgattcctagagtttcgccagctttaatcgagaggctaactccctttaaagaccaaaaatgaggcacatctacttttccaagactaaaaaagttttttaattggtcgcttttagtcttatatagatcgtattccttagttacattttttacttctactttgtattctgggttcaatttaacaaacctccactagattaaatccacaaaatgtgaacggaacttgttgtgtaaataacttcctacaatcattactattaaaacaaataaccaaaagacaattgttaaattaacgttaggttgttgccaaatccatcctttatttaacagtgactctctcatcccatttaaaacataataaaatggatttaattctaacaagcgaactaagaatgctggaaaattagacgttgtaaaattgaacaaaaccccactcatgtagaacaacattcttaaaattgactgaagcgtgatatgccagtcgcgaattagcacactaactgtcgaattaaatatcccaaccgcaaacattaaggcaatcatgcatatgaaatagtaaatgaactgaatccacgaaatggaaacataaataccgttagtaaacattaagaaaacgccaaatgccatcattgtccagtaactatacaaattaccgtatattttaatggacggtaaaacgctgactggaaacttcatcttggacactaatccaacttgttggtaaacacttcgtgacgcgtccaaagttgttttattcatgtataaccaaggagcaattcctaaaaccatccatggcaggtaaggcactcctggagcaggatctccacgtttcaaagccactccgaatactagatagtaaattccaatttgaattagcgggtttaaaaattcccacgccaatcctaagtagtggctttggtatgtagctcgatcatcatatttagccattctacgaattatcttaaaattcaagaactggtctttaatgatttgaaacattgcattcataattaaattcccttcatatccgtcatttatgtgatcttaaagcaaaattcaaaatacctttatattttactccgaacttgcttcaaaaaaaacttaacctttggtaatttaagcattcgtttacctaatactatttttcttctcgaattatataaactggtcgttttttcacttctaaataaatttctgcaacatatcgcccaataattccaatacttagcaattgtacgccactaaagaaaagaattattactactagagacggccatccgaaaacagcggatcccggaaaaagtattgctcgcaccacaactacaattgctcctaatatagcaaggcagcaagtaaatataccagacgacgtaacaaatactaaaggagcagtagaaaaagatacaaaactttcaatagcatattttaatagaccccaaaacgaccacgaggtttttcccgcaactcgttcacgattttcatatgaaatatagtaagtattgaaaccgacccaattaaaaagtcctttactaaatcgctcacgttctggcatcgacaaaacgctatcgaccatttttctcgtcattacacgaaaatcacgagcaccatccactagttcaagagaactcacccgattaatccaatgataaaacatgtgtgcaaaaactgagcgaactttactttctcctcggcgattttttcgccgagtagctacagcatcataatctccttcttgaagaattcgcatcattttaggcagcagctctggtggatcttgtaaatccacgtccattaccgctacaaaatctccgctagctttttgaagtccagcatacagagctgcttccttgccaaagttacgagagaaactaatataatgaatttctggatggcttttctggagcttttttattttaactagagttcgatctttagagccatcatcaacaaaaattagttctaaattaacctcaagtagcctttcaactttagataaggttgaataaaataattcaaccgtttcctcttcgttgtatactggtacaattattgatagcttcttcaatgtacttcacccgattcaatcactttaaatactaaccatattggagtttcttaattgaaaaaatctatacttaaaaaatataaatcccttatatcatacctcttctggggcgtggtcaccacgttggttaatatcgtggtctttgctgtgttagtagaccaattacatatattctaccaagtcagtaacgtaattgcttggttcgtgtcggttttggtcgcttacgtcagtaacaaactgtgggtgttcaattcccacactttaaccgccagcgatttatttgccgaagcgctccgctttttcttgatgcgagccgctacgttggcgttagatatcgtcatcctctacgtaggaatttccctgctccacggaaacgacatcttcgttaaaatcattgataacgtcgtcgtcatcatttctaactatgcttttagtaaattagtcgtttttcggacgaagaaaaaatgggagtaatcccatttttttattgctctaatttttctaaagccgtggcttcgtcaatcacttctacacccaggtcttgcgccttagttaatttgctcccggcgtccgcgcccgcaatcaacacgtccgtttttttcgaaaccgaaccggccacgtctgcacctaagttcaacagcttttctttcaactcgttacgggtaaaatgctctaatttaccagttaagaccacctttttaccgttaaaatagttttctggtgcttcgcttggttgcgcgccaaggtattccatattcacgtccacagccttcaactcgtcaatcatgttgcgcgccgcttcactttggaagaaggttgccaaattattggcaagcgtttcaccaaccgtatctaccgcgtcaaattcctctacggaagcctccattaaccggtccattgaaccaaaagcttcggcaagggtccgggccatcttggttcctacgccctggattccaagtccgttaaccaaacgttccaaagaattttgccgactacggtcaatggcttctaggaggttattgacccgcttttccttaaacccgtctaattggcttagttggtcggtagttaatttgtataggtcgtcaaaatggtgaataaatccctttgcataaagttgctgaatttgtttaggccccaaccccataatattcattgcattgcgggatccaaagtgttccaaacgtgccacaatttgcgcggggcaatctgggttaatgcagcgtaaggctacttcaccatttaaatgtactaattctttaccacaagaaggacattgatcgggaatggtcaagtccgccacgtctgctgggcgtttgtccaagacgacccgggtaatttcggggataatatctcctgccttatgcaatagcaccgtgtcgccaatccgaacgtccttagcagtaagctgatccacgttattcaaggttgcccgactcaccgtagttccagctagttgcaccggatccatgaccgccgtcggagtaactacccccgtccggcccactgaccattcaatgtcacgcaccacggttgcttcttcttctggaggaaacttgtacgcaatttcccagcgcggcaccttaaccgtgtgccccaattccgcttgtagccctaagtcattaacttttaaaacaattccgtcaattccataaggcaaatcgtcgcgttggccttcatagcgttcaatataatcccaaacttcgtctaagctgtggcaaaccatctgggtggggttagtgttaaatcctaactctgccattgcctgaatggcctcgtgctgggtttgtacacccaaaacttcgggttccactagcgtatagataaacgtatcgagctcgcgtgctttggtaatttgcgtgtttagttgccgcaaactaccggccgccgcgttccgtgggttagcaaaaacggatttccccgctgccgattgctgttcgtttaacttcgcaaacgccgccttcggcatgtagcattctccccggacttccaaagaaagcggccgactaagggtctggggaaccgatttaatggtctttagattcttggtaatgtcttcaccaatgttaccgtctccccgggtggaaccctgcactagcttaccgtcttcatacactaatgaaatcgctaatccgtcaattttaagctccacgttgtaatcaaccggatggcccacatttttctgaatacgctggtcaaattctgccagctcttccttagagaaaacgtcgcccatcgacagcatcggttcagcgtgggtaaccttggtaaatccggcaagcacttcgccccccacgcgttgggtgattgaatctggcgaagcaatttctggaaatgcttgctctaaagcttgcaagtccgcataattttcatcataaacgtaatcttcaacttcgggagcatccttggtgtagtacaactcactccagcggtcgagcttttcacggagttgttccgcaagttcgttagcttccgttaggttcattttttcaattggcttcggtaaactcatcttttctctcctatatcatgtttctataaattcaggtcaagttcgattggacagtggtctgatccaaaaatctccgtatgaattttagcatccgcgagttgcttgtccaatgcttgggaggtcacaaaataatcgattcgccaacccgcattgttggctcgcgcgttaaaccggtagctccaccacgagtaaacgccctctttatcagggtagaagtagcggtaggtatccgtaaatccgctttgtagcaactcggtaaacttttgccgttcttcatcagtaaaaccggcgttatggtggttagtgcggtcgtttttcaaatcgatttcctcgtgagctacgtttaaatccccacaaaaaattaccggcttagtgtcggcaagttgttttacgtaagctcggaaggcgtcgtcccagttcattcggtaatccaaacgacgtaattccggctgtgaattaggagtgtagcaggtaaccaagaaaaattcctcgtactctagggtgattacccgtccctcttgatcaaattcaggaattcctaaaccgtaagagaccgccaccggttcccgtttagtgaagatggccgttcccgaatatcccttcttttctgcataattccagtattggtggtaccccggcaaatccaggtcaatttgtccttcctgtagcttggtttcttggacacaaaacatatctgcatccaactcgttgaaaacgtccaaaaagccgtgctttactgccgcacgcaaaccattcacattccacgaaattaatttcaaaaccgtgccccccatttctaattatctcttttaattatcgcacaacttgacggaaaattattaaagtttgtctagcaaactaggttgtttaccacttacggaactttacgtttataatcaaactaggaaggtgataaattatgaaaattaacgttgcattatctaacgggtacttacccgatcgttttggcaaatacgcacccgcagccgacaagcttcacgatttgccaattcggtcttttcccattgaaattagtgagttgcctactgacacagcagccttagcgctaactttaattgattacgacgccgttcccgttgctggctttccgtggattcattggatcgcgaccgacattgccgtgaccaatctgattcctgaaaacgccagcgctttggaaaacgggatgacccagggaaagaatagttacgtttctaagtttttagacgtggatgatcccgcaatcttcgaacactattcgggacctaagccgcctaccgaccacgaatatacgttgaccgtttacgcgctcaaggaacctactaacctgcctaagggattttatctaaacgacttaatgcgtaaaaccgaagcattagcattagattcagcgcagattaagattccatcccgcggttaagtttagatcctgattggttactatagggtagaattattgaaaaaacgctttttaagaattgaattctcaaaaagcgttttttggttgattttctaatgtaatgcgacgggtgccagctccttaactaaaaatcggcaacgatgactaaactagacataattaccgattcctaattaatattcacagtctgcgcaattttagttcatttcttaatttttgtttcgccttgctcgggccattttatccaactgcttctgagcttttttagagccccgttctagatctttacgcatttttcgttggtgaaaatcagtaaagaggctctccaagtcataatccacgggatacaatttgttggcggccatttttaaccgcgttcgttttcgtaaaacattttgaaagccatgttctacaaagactgctaccgtgtcatcgccgtgatcttcgtaaactagtcccacctttctgagttccgttaaataaacctgatcgcctttttggtacctcaattcgtttttggctttgtcgggcagctgatcagtcttcgccaacttcggaaactgtattttctcggttgcatatttcgcctgattggtaatatatttatctgcccgctgaatcaatgctttgggcatcctcatttttttggcaatccaaagcgcctgactgtcgccaacttcaccaacttgcagtacgtacttaggagttagtgtttcacgatcaaatttcattgcggccggcgcaaaatccgcatgctttttagtaaaattcttaatctctccataatgggtcgtagcaacgatcaatgctcccttttgatacaagtcttccagaatcgcaatcgccaatccggccccttcgttaggatcagttccgctgcccaactcatctaataaaaccaatgtattgcgaccagccttttgaacaatctttgcaatatttttcatgtgggcagaaaaggtgctgagttgattttcaatattctgctcatcgccgatatccacaaatagttggtcaaaaactgctaattcagtccctgcttgggcaggaacttgtaatccagccatcgccatcaaggttaacaatcccactgttttcatgacgattgtcttaccaccggcgttagcacctgtaataatcaatccccggtaatcctttcctaattgaaagtctaacggcacgggggcaccgaccaagaacgggtgccgcccttgaattatattaatgcgctccgcttggttgatttgcggagtaattccaccgtattcccggctatacttcgcccttgcaaagataatgtcaaacattgtcacagcgtcaatagcatttaaaatacttgttctttgttcacttaattcgcccgttaattcagctaaaatctgatagctttcagattcgataactgccttttgaaacgcgcgtttttcgttaagcttagcgactaaatctagctcgatataaacggtttgaccgttacttgattgatccacaatcgtaccaggaaccttaaatttataggatgctttaattgggacggttatcgagccttgcttttcaattatcaaaacgtcctggatcatcggcttatttttaggacttcgcaaaaacttcattagtttatcttgaatttcgtccttgatagttttaaattgcctccgcgccttccgaagatctcgagaagcatcatctaatacttcataatcatcaaccttttggtaaatgtgttcctcggtagtcgtgaatttagataacgcctggctgtacttatacagggttggtgtctgataccgattcttttcaaagaattttttaacatccggttactacgcaagaaatctgcaaattcgattagctccgcgggtgtcagaatcacgcccttatcaattttattcattaaccggttaatctgtttcaagcctagtaatggaatatattgaccactttcaataattattcgtgcttctttagtttcttgttgtttaaccctgatacttgctaaattactttcaattggcatattttcaagtttctctttactaaaatcaccaactgctttagcaataactccccttttcactcggtcaaattgtaattttttaaataatgattgatcaaacatctctttttcctctcataaaagagacacctatccgataaaacctaattaaaacaaaaaaagaccacagtaatcccctgtcgtcttcaaactaaacttaaaatttattttgacaggtatcgcttgtaaaagcatgccaaaaaaaccgtcttccccggttcaattagcgccaatatttacatttagatacttgccacgctcatcaaaatttccccattcgtgtttagataggttttatcaacaagtaaattaacaaattttaataagctcgtcaaatatttactttttaagtcctcattaacaattagaattctttaaattatttttttaaagttgcgtatttaaatttagggaggttacccgccattccagccttgtacgttggtaaatatacaattatgtctccacaattaaattcaattgaaattatataacaaatttgttatatttctaagtattaaagaggttgatttatgtacgaaattgatttttattttgacagcaatggaaaaagcccagtatccgattatattgtggctctttctaaaagccaccaaaaaaatgatcgagctattctaaaaaaaattattcaccagcttgatttgttacaagatttaggaccgctcttaaaagaacctcaggtcaaatttataaagggctataaacatcccctgatggagctaagaccacaacccgaaagaattttttacgcctcttggaataaaaatcgttatattctgcttcatcattactctaagaaaaaaaatcgaaccgatccacgggaagttcacatcgcgattaacagattagacgactggttacaacgacattagaaaggattagttgatatggctacttggaacgaactcagaaaaaaagtcactaagaatattccaactgaagagttaaaccttattgaaactcttacttatctacaagagcgtcgaatcaagctaaacattacgcaaaaagagttgggtaaaagaattggcatggcacaatctcgtatcgctaaaattgaaagtcttgactccaccccttctctagaaactctaaatcgctatgcacatggtttaggattggaaattaaactaactttaaaatcattccttcataaccagtagtcgttcttttcaatataaacactgctctaactatagttcatagattctatgtataaaactcatatttaaaataaaacagagggcgaaattcacaactgaattccgtcctctgttaatttttaaccattttcttgaaccgtccttctccccatgaagaatgcttcaagtcttttctctctttatttttgctagctttttaaccagtcatatattcttggctgcgatcgctaaatcgcttctccgtaaaaccacattttccatattctagtacggctgtgccgaaacgggctccgaaacccagtcccctccggttaaccaaattaggacatcaatcgctcaacccacgattaatgccctaattaagttagtcctcgagacctaatcgggtcctctagataaattgaatcaacgtcatcacaattggtacgactacgatgaataggatcgtacttgtcgttaccaagttggttgcgtattttacgtcaccatgtgattcgtttgctaggattggcataaccgctaatcctggtgctgctgcttgcacaatcaatgtttgcatttccatcgttggcaatacgtgtccggtgtgtgcaccaaacaaaatcaaaccggtaattaccaatggtgacagtacgaaacgaccaagtaatgcaaagaccgtatcacggtcgaagtggatactcttcaatccggcatcgtaaagcacaatcccaatgtaaattaatgacaatggggttaccaaattacccacgtaactcaaggtgttacctgcccaacttggcactggcaaaccgagtaccaaccagatgatggcaacgataaaaccaagaagtggtggtggaagaagcttcttccagttcactttacgttctgtaccttggtcacccttttgcttagtggggtcgtcgttggcaatcaagaataccccgaacgcccacgtcgaaaccgtgttagttacgtagtaaaccaagaaatatgccaaactttgcgaaccaaacagcgcaatgttcagtggcaatccaatgaaaatggtatttgcgttaactacggtattcataaagagtccgcgacgtcctgggcgaacctttaataacttaaccgtaatccatgcgatgatatatccaataattactccaccaaacgaataaatcaatccgcttgataaactaactagttttggtaacgttaaatacttcattaccgatacaaaaattgaagctggtagagctacgttcataattaattttgaaatactaccactaaaatggtcgtcaaaccatcccattcctcgtagaccaaagccaagggccatcatcaacagaatggtaataatactttcaacggacgtaataaatgccgccatcttacccactctctctttctctttataacgagcttttggaaaatcttcttaattcctgtacttctctgctgcacagtcgaaacgtgtttttaaacccaacttcctccggctaaccaatcacagcatcaatcgccaaacccgcgattaatgctgtgatctagttagtcctcagaagctacccgggtctaaaaacactctaattttcttaatcctcgaagattacccgaattcactcactctctcttttgttattcgtcattttcaacggatcgacccaccggtcaaagtccgcttcattcaccaaaccgctctttaatgcagcttgtttgaggctcaatccttcccgacttgctagttgggcaatctctgccgcttgatgataaccaatatgtggcgacagcgccgtcacggtcattagtgattgttccaccaagtccagcatccggtcggcgttaatttcaattcccgcgaccatcttttcggtaaactgagccaccaccccgcttaacaaattgacggaatctaaaaagttgaagataattaccggtttataaacgttcatctcaaagtttccttggctagcagcaacgttaatcgttacgtcattacccattacctgagttgctgccatggtcaatgcttccgcttgggttggattaaccttaccaggcatgattgaagacccgggttcgttagccggaatcgtcaattccccataaccagcccgcggaccgcttgctaggaaacggatgtcattagcgatttttaacaaatcggctgccaaagttttcaccgcgccgtgcacagctccaattccagaatgtgcactaagcccgaagaacttattttgggtcgtaaatcgtaagtcgtacaccttactcaattcgttgaccatttctaagtcataaccggcaggagcgttcaatcccgttcccactgcggttcccccaatcggtagctctaataacgtatccttgagcttcgccaagtaatctaaatcatgttctaacgtacttacccaaccgctaatttcttggccgaaagtcaagggcgttgcatcttgtagatgggttcgcccgattttaaccacgtcccaatactgtctttgtttttccgttaatgtggcaatcaagtttttaatcactggtagaaggtggttaattgcttgactcgccgcaatgttcattgccgtagggaagtcgtcgttagaactttgcgatttgttgacgtcgtcgttaggtaaaagcgccaaatcagaatcaatttgttgggcaacgtgcacaatcacttcgttgacgttcatgttcgtctgggttcccgaaccagtttggaaaacgcgcagggggaaatcctgcattaaagttgcatcatctaaggccaataattggtcactcgccttttgaattaaccgcgttttttcggtaggtaataatccaaaccgattgttcacccccgcagccgcctttttgacgttaattaatgctcgaattacttcgaccggcatcaacggtcccgtcgcaaaattgtgccgactgcgttcagtttgtgcgccccataaagcctgttgaggcacctttacctttcctaatgtatcttcttcaattcgatagtccgccatcgttatcgctcctaatttttagtattcaggagtccaccgggtatctgccaccgcttttttcacgtcggtgatggtttcttttgtcaatccttgatcaactgcactttgggcaatgccttccgcaaccgtttgtgagaattcactcaacttggaaactggtggcaataccgctgctcctggtttgcttacgtctacgataccgcccaatgaatgagcagccttagaaatcattgtatcatttaatactttagcagttgaggcaatgacccctaaacctaaaccagggtaaaccaacgcgttgttagcttgaccaatttggtaagtaacaccgttgtattcaatatcgtcaaccgggattccggtagcaatcaaggcgcgaccatccgtccatttcaacaagtcttccgcctttgcttcagctaacttagttgggttagacaatgggaagataattggacgttccgtatgagcagccatttcacgaaccacttcttcggtgaaggcacctggttttgtagaagtacccaccatgatagttgggtggactgccttcactacggatagcaagtcggtcaattcttctgggttttcaaattcgctgcgcttacgtgcaaatggcttttgttccggcgtcaacgtttcgtcatcatcaaacaaaagaccttgcttgtcgaccatgtagaagtgtttcttagcttcttcttcggacaagccgttttcaaccatttctgcgtaaatccggctcaagattccggcacctgcagttccagcaccgaagcttaggtaaacttggtccgtaatcttttgcttagaaatatttaaggcacctaaaataccagccaaagtaataattccggtaccttgaatgtcatcgttgaaaattacgtaacgatccttgtacttgttcaaaatctttgccgcgtggtcacgtccaaagtcttcaaagtgtagatacatatttgggaataggttttctgcagtttgaacaaattgatccacaaattcaaagtaacggtcgcccttgatccgttcgtgacggttaccaaggtacattggatccttcaacaacttttcgttgttggttcctacatccaatacaactggaagaacttggcttgggtcaattccagcagcagcggtataaaccatcaacttaccaaccgaaatgtcgacaccgttagttccccagtcaccgattcctaaaataccttctgcatcagtaactacgattaaacgaatgtctcgaccatcagccgcgttcttcaacgccgtttccatgttatctggatcatcaatggaaaggaaagttgcgttttgtgattgaacataaagctcactgtagttttcgatcgtatccgcaatggtaggatcgtaaacaattggcataaattcaacaacgtgttcactgaacaacttgtagaatagtacccggttttcattgaaaatttgcatcaagaataaccgtttttctaaatcattagccttagtttgaaattgagcgtaagtttgtgctacctgttcatccaaagtttggaggtatggtggaatcaaaccgttaagccctaactgatcgcgttctgcttttgtaaaagcagttcccttatttaaataaggattgttcaaaatactcattgctttttcagtcattttgctttcctccaattttttattacgcggtaagtttaagactcctagattgctatagtcaaattattagcatattataaattatttttatatttaaccgaaaaagcttgatataatagggttatggaggaacgttatgaacactaaagatttaaaatattttcattcgctagtaaaaaataaaaatttttctacggttgctgaagaatttaacgttagtcaacccgctatcagcatggctatccgacgcttagaagatacttttcaaaccacgctattcacccgggatcaaggccgacaccatttgtccgtcaccctaagcggccaacaactggacgaacacgtacaagcaatcttggaccacctaaccgtcgcccaaaatagcattaaaaatatcaatacaaaaaaattaatcttgggtctgccacccattatgaccaagtactttttcccgcggattgccaaacgccttaccgaacaaaatttgttaaaggccatcgtgcccgtggaaaaagggtcggctgagctagaggaaatgctgcttgctgggaccctcgacatgtccctaatgggggccatcgaaaagcaattcaacgaaaatctagcttaccaacatttgggcaacgaccattttgtcgcaattgtcggtaaccaatcgcccttcttttctcgcgacaaaatctggttctccgaattaaaaaacgagtcgtttatcacctttgatagcaattttgttcatgcggaggctctgcgtaatttcagcaacattaccaattttcggcctaacgtggtttaccaaagcaatgattcccaagtaattcaagaaatggtggcccaaaacgtaggggtgggttttatcgtcaattctgcggtaattaaacgcccggacgttcgggttctgccctttttcgatgaagagcaacccttgttttacatgaacctggtccaacgtaaagaccggatcttaagtccttaccaacaaagaattgccgatttgattcgggagtagtcaataaaagtcgaatagttagtgcgtgctaatataaaaagcggttattatgccaattccagacataataaccgcttttgggattaagcaagcgccctcgaattttgttaaccagctcacgctgaaaattctcgtgcttctttgctgcatggccgaaatgggctccgtaacccacctctctccggttaaccaaaataccggctcaatcgccaaaagcgcgattaatccggcatttctgttaatccttgcgcttctttgctacatagccgaaatggactccgtaacccacctctctccggttaaccaaaatgcggcatcaatcgcctaaaccgcgattaatgccgcatttccgttaatacttgcgctttcctgctgtatagtcaaaatgggctccagtgcccaatctcttccggttaaccaaaataccggctcaatcgccaaaagcgcgattaatccggcatttctgttaatcctaggagattacccgggcacttccgccctctagtttttaaaccattcgtcaatttccttatattcttgttcgctaagttcaatttccgttgcctttgcgttgctttccacttgttccggtttgcgtgctcctggaattaccacgctgatggccggattcttcaggtaccacgccaagatcacttgcgccacggtcgcttgttttgcttccgcaatttggcgtaccttttcagttgcttcaattatctgattaaattgagcttccgagtactggtcaaagcgttcatgatccttcttcgtatattttcccgtaagaattccggacgccaatgggaagtatggtacaaaagaaatttggtgttctgcgagatatgggaacaattccttttctgcatcccggtgcactaaactataatcatcttcgacaacgtcgatcacgtcttccacgttagcttccttaatttgtgctaaggagaaattagaaaccccaatggctttaatttttccttctttacgtgccttaactaacgcgttgattgcctcgtatttgttagtaatttcgtctggaaaatggatgtaaaaaatatcgatatagtccgttttcaaccgccgcaaagctgcgtcgatttgtaacgtcaaaaattctggatcgttgttgggttggtaatcgtgcagcggatcttgggccgccttagttgccaaaaccactttagagcggtcgtaatcttgtaaaacgtcgccaataatctcttctgaacggcccttcccataaataaaggcggtatctagcaattgaattccctcatccaacgccttccgcacgaccgcataaccatcttcatcctttaaattcgggaacaaattatgcccgccaactttattagttcctaatcctaacgccgtggtttctacgtcacttttaccaattcgaactaaatttgccatacgattacctccagttatattttcgtgattagcataacagataatcaaaaaaaagggacccctttagttttaatagttctgtcagtaaacatttaacgcaacaagtttttgccatcgggtcattaccgcgctttcctgctgcatagccgaaatgggctccgtaaccccagctctctccggttaaccaaaatactggctcaatcgccaaaagcgcgattaatccggcatttctgttaatccttgcgcttctttgccgcatagccgaaatgggctccgtaacccaactctctccggttaaccaaaatgcggcatcaaccgcctaaaccgcgattaatgccgcattttcattaatcctcaagagctacccgggttactccgccctctgttttatgtattcctctacgtattttcgatttccgtgctgtaacgttactaccagcgtatcgcccgccttaattaccgtatctccagacggaacaattgcgcgcgggcccctctgaatactaatcaataaactatgtgcgggccattgcgcgttgcggactgccgccccgtcaaattgggagccttcctttacaaatacttccacccgttcttggcgaccctgcggttccgctaaaatatccggcaccaactggtggagcaacgattcgtaaattggttcgccgcccaataaatccaacacaatgtaggctactagcgccaccaccgctaacggcattaaatgctgcaacgaccccaccatttcagtaatcaacaggatggccgtaaacggcgccttcccaattgaggcaaagtagcccgccatggcgtaaatcacaaagttaggtaagtaacgggcgtcgatcaacccccagtgtgccattatgcttacgtaaagggcgccacttaccgctccgagcgttaatataggaagaaaaattccacccggtagccctgaaccgtacgaaaccatggagaaaacaaaccgaatccctagtaaaatcaagagcgttacaaacaccggattttgcgccgcaatcgtggtaatcagcgtgtttcccccgccaaggtaggccggccatccccagcctaccggaataattaagataaagggtactaaactatccaaccatcgcggtaaaaatttaattttaccgtaccaagtctttaatttcagcgtgcagatttgatacaaccggccaaaaagtcccagtaaaattcctaataccaacaagtgccagtatgaattaagcggcagtgcgtggggataaacaattgccaacacgggggttagcccaaaaaaagtcagcgaaatgaagtttgccaccaccgcactcgtcagcgcactaatccacactaacgtggaaaagttgtggtaaatttcttctagcacgaacagggtgctcgcaatcggagcattaaaggctgcggatagaccggcagcagctcctccggcgattaacacccggcgttgcgaaccgcggtaccgtaaagtttcgctccagccttgccctacggctgctcctagctgaatcgaagggccttctcgtcctaacattagtcccgaaccaattgctaaaatacccccgacaaactttttccacaataccggccaccattgttcctcgtattctcccgatagctgtccttcaatttggggaatcccggatcccgaaatatctggcgtcgttttaactaaaaagcctactccgactgctaaaataagatttaacaggacaatccactgccagtcggtggaaaaattttggtatagctgttggaaaaagattaatagcttttcaatcgtcagtcgaaaaatactaacaattaatccgattaagccgcccaccaccactgaattcaacagggttgatagacgggtgtcttcaatttttaaatgcatcagcattccacctcgttcaaaagattaaccttacttatattagcataactaaaactctcgccaagttttgaatttaggatttgttagaaacctgtataatggattggtaagaataattgaggatggtgttataaatgaaaaaagtagttagctttgcagggtttgacaccttgtttaacgtgcaacccttctacgaagcggttggacgaattggcaaccgctacgatattgacgaaaaaaaggttcgggatacttaccgccaaaaagaacaagctttaatgcaacaaagtgagtttatgaagtactctaaactaatggaagtggctctaaacgaaactgcagaagaactaaacttcacgattgacccaagtgattttagtgacgttttaattgcccacacggtaatggagccgttccccgatgcaccaactgcactatataacattaaagaaaaaggctacgagaccgtcttactgaccaaccactctaaagatttaattcaagctaacgtggttaaactggaacataattttgaccaaatcatcaccgccgaagacgtccaggcttacaaacctaacgcacgattcttcgcatacgttgcccaacagttaggtgacgttgacgaacacgttcacatcgcggtcgaccctattaaggatatccaaccggcccaagcagcaggctggcaagtaatccaaattgaccgccaggacgacaacgctaaggtagcttccttaatggacgccgtagatcaattggactaagacaagcttagcgaccaaagcgaaaaaattaccgacaagctcgtaacctaatgaaaacaggaaccagaatttaagctctggttcctgtttttttaaaccgacaaatgcaggattggaaatagttactaactctaagattccggaagcgcgacaatttatcaattaagggtgtttaaatcgcttctaacgactaatatttctccgtataaacagagatagtcccgttttattttaataacccgctttaatagtttaacgtgtgatataatctccgtagagtgtataacctactactcatccttctaaatattagaagaacacaaacactacgctgtttaaccaggagttaaaaattaatgactactatatctaaaaacaatattattctaggagaatttttgaaaggtttctatgacccgcaatttacatgggacgccgaagaaactaacgggctaaccgaaatttgccaaccgctggcccagtctgccgcctattacgacattcccgtctacgttttagctaacgggattgggcaaaaaaagcaagctaatttacatattgaacctgtgcaagttaaccctcagcgatataaattaacgctatactttatccgttgggaacttgcgttaaattttttggtccagcatcccgaatttgaaaaagtagctttagttgacgctaccgatgttactgtactcaactatccctttgaccaagtagaagatcagtttttatattttggcgacgaaattaactacttagatgcgggaattattaaaagggatcccaaaacgcccgaaatgaggaactttttcgaagaaaatcccgaactacagctactcaacccaggggtgatcgtgggaacgcgagaaatgattattgaatttttaacaatcttcgttagcacctttaatcgtattcaagtagaagaaatgcgcggagtgccggaacaaaggctgggtaactacgagatgtctttagttaactacatcgcttaccggtacttttataaccggatcagacatggccgcgaagtcagtaccctttttatgtacaatgaacgtactagcggtgcatggtttaagcacaaataacgggtggtaaaaaatggatattaaaaaattaatgcatatgcttgataagcaagaatggattgttgaaaatgcgggagatgacgggaccggagcaacgattgagatgggtcaaaatcaagggattttaattctacaattaaaccccaatggaaaggtctccttcccaactcggatgggatttcttccccctgagtattgcaactggcagtttaacgaagctcaacaattagttgaactcatggataaggactaccaaataacgacaagctttagccttcctcaaaaggagggcttgcatttaatcatgagggaacataacccgcaaggtatttcgcgaagactaattacgcgtcctaagttatttaaagaaataaggaaacctatcattcctgctccacaactagcggccggcaaaatgattttaactaaaaactatcaacctgattctaaaataggaaaaatcgcaaaaaacaatgtcttgggagtccaccgcattcaaaatgacctaaaacatttggctggtgtcaatgaaattctcaattacctaatagagcattccgctttgaaagaaatcgccgttatcagtgatgaaaatttacaggacaatccgtttgtaaagttagatcgttccaaaattagagtcaatagttcgttaaccattttggttgcttcaagagcgctgctgatcgaacttctgggacaggtcctgattgaagcctatcaccaagcatttgaaaaccaaatcatgcaagatgaagacgttccggtttcaattaaaaataccctggaaactaaatttaaagatcgggtccaatggatataaatttaaataccactaatactaaataaatatttggaggctgggaattttccctcagcctcttttttgattactaaaaaacactcgtttgtctcaatcgggtattgtttttaaacgtagttatcttccccattaaagaaagcacttaaacaccttaaaaacgcctgtactatagtaatttcttgtggtcgttctcgacaaaactttctatttctaaattacttacaaatagtttataattatcttgaagttcagaaagcgctttcttaaacttcatcattcttaaatatttatggaggtacagacatggcagataaatacattctggccatcgacgaggggaccacgagcacgcgtgcgatcatattcgatcatgctgggcgcaaagttgccgatgcgcaacgcgaatttacgcaatatttccctaagccggggtgggtagaacacaatgccaacgaaatttggaacgccgtttcgtctacgattgcgaatgcttttattgactcaggcatcaagcccagtcaaattagcggaattgggattaccaatcaacgggaaacgaccgtcatttgggataagaaaactggcttgccaatttataacgcaatcgtatggcaatcgcggcaaactgctgatattgccgaccaactaattaaagacggctatggcgacctgattcaccaaaaaaccggcttggtaaccgacgcctacttctccgcgactaaaattcgctggattctcgaccacattaacggtgctcaagaacgtgccgagcgcggtgaactcctttttggcaccatcgacacgtggctagtttggaaactaaccgatggtgctgttcatgtgactgactactccaacgctagccggaccatgctttacaacattcacgagttgaaatgggactccgagattttgcaattattaaacattcctgaagccatcctgccagaagttaagccaaattcgatggtttacggtaataccaaggattaccacttttatggtagcgaagttccgattgctggaatggccggtgaccaacaggcggccctcttcggccagctcgcgtttgaacccggcatggtcaagaatacttacgggaccggcgcctttaccgtaatgaacattggtgagcaaccgcaattatccgataataatttattaaccaccattggttacggtattaatggcaaggtttactatgctttggaaggaagcatttttgtagccggttcggcaatccagtggctgcgggacggaatgcagctcttcaaaaaggcttccgattcagaagccgccgcgttagcttcgcaaaatgaaaacgaagtctacgtggttcccgccttcactggtctaggtgcgccttactgggattccgacgcccggggtgccgtattcgggattacccgcggaactaccaaagaagactttatcaaggcaaccctgcaatcccttgcgtaccaatcacgggacgttcttgacacgatgaaacgtgattcaggaatcgacatcccggcaatgcgggtggacggcggcgcctccaacaacaattacctgatgcaattccaggctgatattttaggaattgagatacaccgggcccatgatttagaaactaccgcgctgggagcagccttcctagccggcctagccgttggttattggcaagatctcgacgagttaaaagctgaataccaacctggaaaaatcttcaaaccacagatgggcgaagaagaacgccgcgacctttatcaaggttggcaagaagccgtggctgcaacccgaaattttaagcaccaaccgcgtaaagcaaactaactcttaggaggattattacatgtcattttcattattaagtagaagacaagatattgaacgtctaaaaaatgaaacactcgacttactgaccatcggcggtggaattaccggtgcaggagtagccattcaggctagcgccatggggatgaataacggcttaattgagatgcaagattttgcggaaggaacctcttcgcgatcgactaaattagtccacggagggattcgctacctcaaaaacttcgacgttgaagtagtttctgacaccgttaaggaacgggcggtcgtccaagggattgccccccacattccccggcctgatccaatgctgttaccaatttacgacgagccgggatccacttttaacatgttctccgtcaaggttgcgatgaacctatacgaccaactagccggggttacggatcctaaatacactaattacacaatttctaaggaagaagttctccaacgcgaaccccagcttaaccccgacaaattgctgggtggcggtgtttacctggattaccggaataacgacgcccgcctcgtaattgaaaacatcaaaaaagctcacgaaaacgggggcttgatggttagccacgtaaaggcccaacacattttgcacgacgaaaacggcaacgttaacggggtcaacgtaaaggacctcttaactggcgaagaattcgatattcacgcccgtctcgtaatcaacaccaccgggccgtggtccgactttatccgcgaaatggacgaccacctcgaagtaacaccgcaaatgcggcctaccaagggggttcatttagtagtcgatcgttctcggctcaacgtacctcaaccaacctactttgactctggacaacaagacggtcggatggtctttgcgattccgcgggaaggtaaaacctactttggaaccaccgataccgactaccagggtgatttccttcacccgcgggttgaacaagctgacgtggattaccttttgaagacaatcaacgaccgctatccagaagcagaaatcaccattgacgatgtggaagctagctgggcaggtttacggccactaattgcttctaacggcagctccgattacaacggtggcaattccggtaaaattaccgcgcaaagttttgacgaagtaattgcgattgtggataaatacgaaaaacaattagttagtcgcgaagacgtagaagacgtgcttaatcacttagaaagcaccctttccgaaaataaaccgaacccttctgcagtttcccggggtagttcattagatgtggctcaggacggcctaatcacccttgctggcggtaaaatcaccgattaccggaagatggccgcgggggcgattgccttaatcgctaaattgcttaagcaacgcttcaaccggaacttcaactcgatcgactccaagcatctccaagtttctggtggggatatcgacccgcagaacgtggacgccaccttgtcattctttgctaagcaaggtatcgaaagcggcctttccaaacccgaagcggaaaagattgccaacctcttcggatccaacgcggcccgggtctttagtcaaatcggtcgtttgccggctgcacctggcttaagcctcgcagaaaccatcagtctgcactactcaatggaagaagaaatgaccttgacccccgtagattacttgctccggcggactaaccacctcctcttccaccacgacgccatcgccgaccttcaacaaggagtggttgacgaaatggcccgctacttcaactggagtgccgaacaaaaacaacaacatagtcaagaacttcaagatgtaattgctgaagcccacctagattatctgagataggagtaagtttagatatggaaactagtttatggatgcagttagtcggcgaatttgtcggcacattcatcttaattttacttggggacggtgtcgttgctggcgtaactctgaagaaatcaaaagcagagggtgcggggtggatcgcaatctcgcttggctggggattggcagttaccttaggggtgtatacctccgcctttctaagtccggctcacttgaacccagccgtaaccctagggatggcaatggccggtaaatttgcctgggccaacgtgattccttactgcattgcccaaactttgggtggcatccttggcggagtatgcgtttggattcattactacccccactggcaagccactaaggatgccgatgccattcggggaatctttgctaccggaccggcaatccgtaattacgcgatgaacttcatcagtgaagtaattggaactttcgttttagtgttcgctctgttagctttcacccggggcaacttcaccgatggtttgaatccgatcgtggtcggtattttaatcaccgccattggtttatcacttggaggaacgaccggttacgcaattaacccggcgcgggatttaggtccgcggatcgcccacgccatcctccccattgccaataagggcaattccgactgggcgtatagttgggttcccgtatttggtccgatggtcggcggtgcgttaggtgccttgttatttaacgtgttaccgtagttcacaactgcgcattcattaaaacgtatgcgaacaaactaagaaattttttcacagatgaacatttttccgaaaattattttggtgtgctgactttaatagcgccaaaaaccagtttatttcctctaacccgaaatcgatcattgtgcccaattcaggcataatggtcgatttttagttagtgctcacaagctcttccgttgttgtcccccgcgcttttttacgtccttatccacggctaatttgctaacctcccaaaaaattgatacacaaactcttttacagcgtttataatcaatggtaggctagaagcgtttaagagtaaaaacactgtttaatccacagcattgttccttattctaaaagcgcccaaaaacggaggaattacatatgcaaattgaacccaacgtcgttatcagtcagttcttcactcatatggaagatctacttcatcatgcagacactagtaacgtagatattccaagtaaggtagcggaacaaactcattctttagctcgttttaacgttccgtactacgtcttgactaacgattccacccaagaacccattgataacctccacgtggttaacgttaacttggataaaatatatcaaagctatcctgatatgaccctttatttctatcggatttttatgaccttttattttttacaggcccatcccgaaatcgaaaaagcagtcctaactgacgcgaccgacgttaccatgctaaactatccgttcgacgagattaaacccgatacgctatacatgggcgacgaaactgcatttttacttgaaactgacattattcttaataacgaaggtccccagtatttacaagactttttcttgagaaacggcaatttgctccccaccctaaatttaggggtgatggctggaactcgtgcagtactaatggaataccttggaatgatggtcaaactaattaccgaagccaaattaaaattcaagcaaggcgacgaacgttaccggctcggagcatttgaaatggcgatttccaattacgtggcttacgaatatttccaagatcgtttggtccatggtcgtaaagtaactagctttttctccggttttcaacctcacagtagtgcttggtttaaacataaataaacaaggagcacgattgaatgttaaataaaaaacaagtttatcaactactacgtgaccgggaatggatcttaaaacaaacaactcctgataccgaagttcctggttttatgagttttataactagtttagacgatcctcgtgcattcttttctattgaattcaaggataacggccggttagaattccctactggaattaaatacgtacctgtagaatatggcggttgggattttaatgaagaaactcaagaacttatatttgttagtcgcgatggtcagtcaaatcttcgggcggatctaccccaaaaattaccttacggaatcatggcgttcaaaatttataacgattacattaatcccttgtacttttttgttaattatccgcacattgaccaggagcaggtaaccagccactgcttaggcggcaccaaagctttcttcctgccccgttcagcctatgacaaaggcttctaccagaccctgcgttggactggttttaatactaacttggtcgaccacgaggatgatcgggtggccatgcttacggaaatttatgattaccttgcgtaccatccccaaattgaacaggtggtcttttctcaaaccaatcaaccggtcgtgcaactcccggaaaagcagcacctcttgttcactcttgaaagcggacaaccttcattggattatttttcaggaacccgggcagcaattatggaattgctctcgttaatcatctccgaaaataacctgcgcctatacaatgatgctgatcaacgtgatgaaactactatgttacaagacgttatcgctaattgcttcacgggacgttacgaagtgatcgactcgcttccagaagcaacttcactttggcagattttgttgcatttttaaaacatttgtaggaaatactttattgtcatactaacggtcgatcaacggaaacttagaaaattatcccgtttgaaaaacttgcccggataactttaagtatctttaaggaaggaattcatttgaatgctaaacaaaaaacaagtctataatttattgcgcgaacgggtgtggattctgcaatattttaataaagatatggcacaccccggacttattaaccttttacctaagccggcctttttatgctttacgtttaaaaagaatgggcgcatagatgtacccaatggcgtaggttttatccccgatgaatacaatggttgggattttgatgaagcaagccaagaaattatttttactgaacaaaatggtaaaccacgaattcgtactagcttgcctaagcaattaccttatggaattgaaatactcaaacagacgggcgcgcttcctggagatggcaatacgatatatttttttgtcaactacccgcaccttaatagcacctacgctgcggaacaatttttaggaggcactaaggcctttttcctacctcgctcaagctacacaaaagacttttatgatactttgcgatggaccggctttaataccaatctagtcgaccacgaagataatcgggtagccatgcttacggaaatttatgattaccttgcgtaccatccgcaaattaagcaagtaatcttcgcccaagctaatattcccgtcgtgcaacttccgaaaaaacagcatcttttgtttacccttgcagacgggcaaccctcattggattatttttcaggaacccgggcagcaattatggaattgctctcgttaatcatctccgaaaataacttacgcctatacaatgatgctgatcaacgtgatgaaactgccatgctacaagacattatcactaatcattttgcaggtcgttacgaagtgattgactcgcttccagaagcaacttcactttggcagattttgctggaaatttaaaattactcgatactattacaacttgcacaaacatagaaaaactgacacaaaaacatttcgataacgtttataatgaaagtaattcataatcgctgacgataactattagctctagtaaagtcaacacgctaaattttttagacatagcttacaactaacaccgtatagctacaaaattagaccctttttagtggttaacaagagcatagtagtgcatggtttaaacataaataaaggatgtacaattgatgataaatagacaagaagtttttaacctaatacgtgatcggatttggatttaccaaagcgtaatgaattctgatcccaatccaattttgctcactttaacaggaagtgatgaagaaacgacaaaatcgttctttagcctttacttccatgaggatggccgggtttctgcggccacgaaagttgggttcttccctaatgaatttgccgattgggattttgacgaagccactcaggaaattatttttattaaccgtgatgaccaatctgagctccgggcaagcctcccgcaagagttatcatatggcgggctagacgccattaagcttaaaaatgaacaagctgacgcagatagaaccatccagttcgtaaacaatcctgaatttgatcgctttgaaataactaaatcgtctctaagcggaaaaaaagttttcatcgctcctcgagcaaattatgaaccttactttcgttttagtatgcgctggaatggttttaacattaaactaactaaccattcagtcccttcagttgaattcttcagtgatgcatatgatcatttagttgctcacccgcacgtagaggagattatactctcgcaaaaaaataaggatattatcgaatttccaagggatcaaaagttattgttcttaaataaccaaggcaccccctcgttcgaatatctttctggaaaccgttcggcaataatggaacttctcatcgtaattttatccgaaaacaatttacgtttgtttgatgatggtgatcagcgtgatgaaactaccatgttgcaggatattttaactaaccattttcaaggacggtatgaattaaaagatctacctgaattttaacaaggttggcctgttttcagagacatccattccttggtataaccgttaattctaacaaaagcagcgtaataaaggagttttaaatgaaagttgaacctaatatagtactcagtgtatttatcactaatatggaggacattaaccaccacgaagacactactaatgtcgacattcccagtaaagttgctacgcaggcgcactcactagaaaattttcaagtgccctattacttattaaccaacgaacctagtcaggaaaaaattgagaatctaagcatcgttaacgttaatttagatcggatatatcacaattattctgacttatccgtatattttcttcgcatatttatggcgtttaaatttttacaggaccatcctgaaattgaaaaggctgcgatcacggatgcttccgacgttacaatgctaaattatccttttgatcgagttaaaccagataccctatacataggggatgagccccattctgtagcacttagtgtacagactttcatagaagacgatccgcaatatatttacgattatcttcttgaaaatagtgacctatttcttacgttgaatccaggtgtgctcgtcggcactcgtgaaattttaatcgagtatttaggaatcatggtcaaattactgtccgaagcaaaattaaaatttaagcaaggtgatgaaacatatcacttaggaccatatgacatgtcaatttctaactatgttgcgtacaaatattttagtgatcgattaattcatggacgtgaagtcagcactatttttaatggttaccaggaacgcagcagcgcgtggtttaaacataaataaagcaactttactaattcgaatacagtcacaataaaaattaatcggtaactaactgccgattaaggttatattcctaactaaattaaactttatttccctaggtagtattttagggaatttaatgcacagcaaaaccactattttccgacaatacctgactctcaatggttattttacatccgttaggcgtttttattagttacccatcatgtctgatgaagacacatcgactaccacaatataaggagtacaccacgttgttaacaaaaaaagatgtagaaaaattaatttgtaaccgtttttggttatttatctctgttactgaaaacaaagattttgtcttgctcttcattgggagaggagccaccgatgcttatctagccatccggttcgaattgaacggcgaaattacttttcctactcatctagcatttaacccacctgaatactcacgttgggactttgatgaagaaaaacaagaaattttaatttttgataccgataatcaacttaggatccggggaaaacttccaactaaatggttaagtaatagtgttcaaattcaactgtttgatggagtagacggaatcttggtccacagcccgcgttttgacgcgtctcaagttactgagcgaactctcggcggaaagaatatgtactttgtccctcgacaagcttttaacatggaaatcttccacgatattagtcgggaagacttcaatctcaaagtactcgattgtcaagaatctatcctcaattttttcgatcaggcttacgaatacattgctcagcatccgcaactagaaaacgttgtgcttgctaaagagggccagccagtgattaaacttcctgaggaggatcagcttatttttgctaaggatgccgagtcgccttcatttaactattttgctggcagtcgagctcgtgttattgagttattaatcattattttatcggaaaataataagcgcttgctcaatccggatgactctcgtactgaagatgaattgttagcagatgtactaaacacccaatacagtgggcaattcactctaacgcaagtttaatcatccgttaaaattgaaatagcaattaatcaacatacttatttaaaagcaataataaggagttacacatgaaagttgaaaaaaatgttgtaattagtgaattcattgttaacatgtatgaccctcactacgggcaagacaatagtaatgtcgacattcctgaaaggactcgaactcaagccgaatctttaacgcggtttcgcgtgccgtactacgtgttaactaatgcagaaggtcagaaagcagaaactggtgcccacattattcacatggacttatttaaccactatcctgacctaactttgtacttccatcgaatcttgatggctttcgaattcctacaaaaacaccccgaaattgagaaagttgcactaactgacgcgggagacgttacaatggctaactatccctttgataaagtcgaggaaggtactttatacatgggcgacgaaagcttctatatctttgccactcctgtaattacttggcacaaagatcttcaacgtattgaggattttataagggaaaatggactattgcctaccttaaacttgggcgtgatggtcggaacccgagccgtattactcgaatttttagggattatggttgacattattaccgaagctcaactaaaacttagccaaggagacgatagttaccggttaagcgacgtggagatggcaatttcaaattacgtcgcttacaagtattttggcgatcgtttagtccacggccgagaagttactacggtaatggacggttatcaagaaccaagtagcgcatggtttaagcacaaataaggagtttttggcaatgttaaataaagaacaattaaaagatttaatttgtgaccgtttttggacatttcggggatttgatgataaaaagcattttagcaccttgtttattggtacagagcctggttctggaatgctagcactttggtttcatcgcgatggtagcatcactttccctactaacgtagcttttgaacctggtgaataccgccactgggattttgatgaagacgcccaagaaattattttctttgattataaccaacagcctagcaagcgcgcacattgccccgttcaatggtttggtgacagtcttaagatcgaattaatctcggactcggataataccgaagtcttctcacacgaaccacacgttgaccaatttgcccttaaaaaccgggtaattgggggaatccatatgttttttgcccctcgcagcgtttataatttcgaactgtttcaagatttagcttttttaaatttcaatatcaaactgattgataccgaagattccatcatagattttcttcatgaagtttatcaatacgcaatcgcgcacccccaactagaggaattggtaatttctcaagaaggacaaccacacgttcaactgtcacgagaacacaaactattgttcactagcaacgatggccagccgtcgtataactatttttctggtgaacggccgttagttatcgaattattgaccgtgattttagctgaaaataggaaacggctgctcaatccagatgattcgcgaaatgaaaaagaaatgatccaagatattatttcaaaccgatttaccgaccgctacgaaattgtataaatatccctcacaaaagcaaaaattgccttaaaacgcaacagagaccagaactttccaattctggtctctgttttttatttaaattatttatcacactgttttagtcgctcgccaaaattttcttttaaataaggcatcaaggattgctcataatggtcatcgtccattaacttatgctcaaacgcttcatggttcaagtcgattaaaaacttacccagcatttctaacattaaatctcgtggagcccttataaacgactgctggtcatcaaatactagctgattgtcattcgtcgaatcaaatgactcgaagggattagctgcaaagtccaagtcaaacataatcgcaactttttttaaatatggatgttcaattaagtaatcaaaaatttcttggataccttgccatgtttggggattttcatctaaacagtgtacattcaatccaagattttcaactagctgacctagttgtgtttgattatcatattgataggccaatatcatcgacccatgatctgactgcggatccggagcaacttgtaaatttgattttttgaaaatagcgtcccaaacgcgaaaatgttcgtgtttaccataagcatccataaccaatgtggcaccttctcgtactggtaaactaagggtttgttctacttctccttggacaccataaaccaaaattttttgttgttgctcgtcgaagtcccagcgatgacattctggagggataaaacccacgttagttgggaaatcaattgtcccatccggcatgaatttcaaggctaaaatttccttgcctccaagcgtaagacttactcccacgtcattaatttcataaaaccattcgtagtctttgatcatttcaaatgcttctttaaaatccatcttaaaatactcctatttatgtttaaaccacgcactgctaactggttcccaatagttaaacttggtacttacttcgcgtccatgctttaagcgacgtttaaagtatcgatatgcaacataattaactagcgccatttcataatccccaaaagctgatttaggaacctgtcgcatcttttgaacttgtgcccgagtaaaaatctctaccagaatcgttaaaaattccataattactgcacgagctcctacaataacccccgggttcaacatttggagttgcgaattttctataaagaatctttccataaaatcaggctttttatcgcccttgacaattccgccgccgatgcttttaagctcgtccccaaaatataaaattccgtcttcaactctgtcaaaaggatagttatagacttccacatctgaaaaatctacaagtgctactttctttatttctggatgtttaaccaaaaaatctagtgccatttcccaacggataaagtaaattgaaacatcatagcgattcgcatcaacatccatgttaacgtaatgcgcattttcgtctacgtaatcctcttctaatccattagaaagtatatacaccgggagctgatagtatgctgcagagtgctttaaattttttgctaaagattctacgccatttgaaaaatgagcatggctttggtactgcggatcgaataaatcggtgatgaactcaccaataatgacattatctgctacaactttatccattttcactacctactcctttaagattattaagctgggtatttaagattaaaatagttaatccgaattacttatatggcctactaatatttcctgctaagaaactaaaaacgcacattgatgtacacggttaattatacacgttatttctgtttctggatacccgtcaaaactattaaacagaccggcaattgcaaatttcaactttaagaggcaacgtcaattttttgacaaaataaaaaaagagaccatccagtctccctttactataattcattttccagcccttttagttttaattaccctagttatgatttaggtaccgcccgatcaatttgcttggtagttaccactttcttagtttgtggttgtgggttttcgaaattgtggttggctaagatcaatttaatcgcgtcaatgtcttcaggggtaatagtcttttgactatatgggtaaaaactatatttgttgtaaactaaaatagcattcattgcatcatcgtcaatattcattctgtaaccatccggcattccataatattgaccattagacgtatggttgagccctaaactatgtcctaattcatgacgcatcgtaataaataacacgttgatgtcataattctcaccatcaggatccaaagctcctttttctaccaggctagcatcaattccagtatttccacttaacgtcgcgcttcccgcatcttttggattagctcccactcttaaagtaatctttttgccggtatcggcagctttaaggaacaccgtcttgcccaaagcatcgttccaactcttcgctgctcgatctaaattgtcgttaaaagcttttaaagcctgggcaggatccttttcgttcgtaaaatcactttctttggcgaaactttggtaaataatttgtccgtccgggttatacgcattatcaatcatttgtgagttaaaatctccgctaataattccatacgtattagtgctacctaaaaattggtcgtctatcaaagcaacgccttcagcatttaccgctggataacgtgattttagatccaggttaagcacgtgctgatcgacccagtaccattggctgccatcgaaacttaccttaataaatttagtcgcttgccccgctcgtttactagttgtgtaggtgtaagtggcgggcatttcggcttggctatagaccgtcgctcccgacttatctcctaaattagcgacattgtccttctccgtctgaccatcttcgaccttggtgtaaaaaggatagtcgttgtttagcaccacgttgtaacgatatgggtgcagcggatccactgccgtagggacgtacttgctcaggaccgggtcgtctttataatcggtagtttcaccaatattgattgttgctggtttccgttgccatacgaaggtgtcgtcgcccatcgttggagcatcaaaattagacattaactctgccgaagtccaaacgtgattgccggcaggttcgtcaacggtgccattacccacgttttgccagtggccggtgtaaccatcagtggtagggacgtccggaatattcatatcatcctttaattgactctttttacctagagctagttgttttagatgatttgtaccttgaagcatagtagatgtatttacttcatcaccaatagtaaatgaagaaatatataactgcgaaactgcagaatttaaaaacatatattccatcgtaccaacttttgaagtatcaaaattacgtaaatctaatttatctacagaagtgccatcaaacatcccttccatattattaacattactagtattgaaagaagacacatcaagatcatgggcgataacattattaaacataaagcccatgctatcaactttgcgtgtgtcgaaattttttatatttaaagagctcaatttacctgcattatcaaacatcccgtacattgacgtaacttgactagtatcaaaaccacttaaatccaaacttttaaaaccagtattaaagaacataaaactcatactggttattttgctagtatcaaaacccttaaaatcaatagattctaaaaccgtgttatcacgaaacatttgatcaccattacccgaataatgtaaattacttatcttagtaattttctgtaaattaggcagatttcccaacatatcagtaatatcatgagcactagtggccttagtaaattcaatactttttacttgcccaggttcaattccattgttacttagaacatcatgtagtggtggcgcttgtccaatatcaccgcccattgacattaattcgccgtcatctgctaatgcccaagtagaattcccccattcaatggctgtcccacgcacatttttctgcgccgccatcgctagttgggtagtgatcagcaacgtggcaataattgcccccgcgatcaccaaacatttcttaattatgtaacgtagattattagtcattacaaacctcctttaaccaaaccaattgttcaaaattttacaatctaattgtataatcaacgttatgaaataagcaagcgaaaccccttacaaaattattcaactgcaaatcatccgtagattacctgcttactggcacaacgttcatggtgcttttttccacaaaaaaatctgctgttaataaccgatctcttagttatcaacaacagatgttaatttttatatgggattttccccaattactttaataactcttttaattccttaaccttgcccccaaaatccacaaacgcttggtcaagatagtcacgtttcgtaacgtcaattcctgctcgtttaacaatttccactggataatcacttgcacctgctgacaggaattccttataacgttcgaccgcacccggcttttggttgatgatatcgtctgccaacgccgtcgcaatcgccttggaagtcgcgtattggtatacgtaatagtcataatagaagtgcggaatttgtgcccaagtatcgtccttccacggtaagtcactgaccgctgccccattataagttttgaagagcccgttaaatttctgagccatcaaatcgggggtgagggtcgttcctttagcatcttcggtataaataaagtgttcaaactctgcaaagagggtttgccggtaaactgttccaataaagttatccacatcctgagttaaaataaaggctttgatttggggatcatcggcatgcttttccagcatgtaatggttgagtaagctttcatttaacgtagaggcgatttctgcaataaaaattgggtattgtgaataccagaaaggttgcgcttgatcggtgtaaacactttgtaaagcatgacctgattcatgagctaaagtagaagtactatcataaatatcgttccagtttagcaaaatatacggatgaactccgtaaacatcgtcttcatagccaccgcttcgtttccccttattttctgcaacgtcaatccaacgctggtcaaattcagtttgtaaatgtgcttgataatccttgcctaacggtgccaacgcggccatcgttgcttttttgccttcttcaaacgacaaactcaacttagcatccgcaactaacggaacgtgccgatcaaattgatacatatctttcaagcctaagaatgacttccggaaagcatagtaatcgtgcatcaaatctaagtgttcatgcgtagtttcaattaacgtatcataaaccttttcgggtattttttgatcacttaagttcatttcacgcgcactcttaaagtggcgaatttcagccataatgttctgcgcgtgcacgtgactgcgaagcgtagccgcgaaggtattccgcatggaccggtacgccttggcaacttggcggctagctttcatccgcatttcttgacttgatgaaagtgcaaattcacttgcagtggcgttggtcaattggacctcttccccattttcatctttgatcatcccgaaatctaagtcggcatcgtccaacttagcagaaatttcggccgcatcgtcgatagctggttgtaattgggccaataacttctcttcgcttggcgttaatgtgtgtgccgcttgggcttgcacgcgtcggagattaaattcgtattgttttaaggctggttcagtttctaggaactggtcgagttgttcagcagaaaggtttgtaattgccggatcgtagaatgcaacggcagcctcccatttatttaagaccaacagtgcttggtttaaaagatcgttgccatgcgggtctgccgtatcgccgtcattgacgcgcgcagcgtagccataaatttttaggactgcttcttcactctcgtagagtaatttagtagccgcaagtaaatcatgggcattttgtattcctttttgagcaagtttttgaatgtcttcaatttgagacttaacggcggcaattgcgtcgtgaaagtctatttccgtagcaaaaatgtccgcaacgttccaagttaggtcaacgggaacttctgcacgggtaggttgttttttagccatggcgtcctcctatattaatgtagattggggttgatgaggattattatactacatagaaagcggaagcccctgggcagcttctgaggactaacagaattcaaggtttaatcgcgggctcgacgattgaagcttgaattgggttagccgcaggaagcttggggctggagcttatttcgactatcttgcataagagcgtcggaatttggttaaccggagaaaactaggtttcagagcgcgtttcgactccgcagcaaagcaccgtccgtctaaaccctgtgaacccccacataaaaaggatcgggaagtttcccaatcctaatttggcttgtttcatttaagctctactacgttttaaatgtacaccaggaattccgggaataccttgactgtttagataactgttaatttttgctacatcaaagccatctatggtggctaagtcctcagtatcagggttgctagccagataaattcctaagttagtatcaatcggatgaatccgatatggatctacttcattagacgttaccagcgtagagtctactttataatcagccgcatccggataatacgacatcaccgtttctagacacgcctctaacatcggcttatctccctgttgaatttcccatttatcagcgacttcccttgccaatttaggaaccaccttattcatatgcatagatgggtaaaaccaaaagtgtaacgcgcgggttcttagatactcatcgatttcttctgggttaacattttctggaataaacgtgtcatcgattccccgggcgatgatttgcgctaaccgtagctccacatttggaaccgcatccatttcaattaaagtgagcgccacctgttttaaatctgcgtaacggctaaatttatttaacatgaatactcctccaatcttttacagttctattgtatatcttttggccttaaaaagatattcagtggcataatttaccccctgttctaccgccttcacttatatttaaaaaaggggctggaaaagcattttccaattcactttaaaatttcggtacattaaattgaaataaggtccttaacgctaaagttaatcgctacgctaaattttacagcgttaggattgacaaaccgaatcgtcgtctgtttagtttccccattgtagtaccaaccctccgcagcggttgcaaaccgtgcggcgttgaggtatcttgacacttcgtttcccgctatcatcaccgccactggtgccaccgtagggcatccaactaccaattctagctccttaaccttggtcgcgtagctgccttcccgctgaaaatctaaagtaactccttgactacacggcgtcacctgaatgtgggttcttagcaagtcccccgtccggtaatcgttagaaatcccgtcgtcttcgtacaaagtaaattttccagcttcactaggttctatcaaaatccgcaacttttcaatcggttcgttatggatgttattgagtcccggactggtgggtaaaatacctccgcttcgtaaaaacatcggaatgctgtttaagtcaaccggaaccgtgatggtttgtccgccgtcataatattggtgagtgtgtaaatcaaaccaccgcgcgccctttggtaaatagattgtcttggttgtttgttgtggttctactacgttagccactaggagcgctggtcccaacataaactcaaagctttcttcagctacttgcggatcttcctgaaattcataaacgaggggccgcatgattggggagcccaccgtagccgcttcgtcgagtaacgaatagaagtacgggatcaaggagtaccgcaatttaatggcgtcgcgtacgtaatgggtatacgctggatacgtccaaggctccgtaacggtgttatccgtattacaagaatgaatcgaaaaccggggttgaaaaattccgttttggacccaccgtacgaaaagctcgggttccggaagcgggccgtcaaagccaccgatatcacatccctgattagctactccggataatcccattcccaaaatcgtcggaatattatatttcaaattcgtccaacttgtatagttatcgccagcccaagtttgcgcataacgctgaattcccgcaaaaccggcccggttaatcaagtacggccgttggtcaggagccgcttcgttaatcgcttcttgtgctgccttagccatcatagttgacataatcggtttaacttcgccaatcgtccggtgcaggccttccgcatcaacttgcgcttggttatcattgatttcatattcgttattatcattccaaattgatgtaattcctaaggagattagcgcttttttcatctcagttttccaagctgctcgcccgtcggcactcgtaaagtccacaaaataggctgaaccgccccagaattggtcggtttggcttgcttgaccatccgccgttttcacgtaggccgctttctgttgaaaactctttgctagcgggtgggtggtcaacatccccggtttgatattaggtgctagtaaaacaccgcgggccttcaattcggcaacgaacttttgtggatcaggaaatcgttttttattccaattgaaaacgtaacgcttcccgtcctttccggaggtgtaacccgaagacaggaagaaaccgtcgcacggaatgtcattttgtttacaagtttccacaaagtcaataatcgcgtcatccgcgtgctcggctagttccgtataaaacatggtcgaacccatataaccaaaagaagccatcggtaccattgccgatttcccggtcaaatccctatagtgttccaccacctttttaatcgttggcccgccaataaagaagacgtctaaatcacctccgtcacattgaaaatagctataccgcaaccaataattgctgtgttcacaatccatatcaaaaaccgaatcccgcgcagtgttgtaaaacaagccgctcgcgacctgattagtaggatcaaaatcaatgtagaacggaatcattttataaagcgggtctgatttttgcgcgttccaccccagtgaatcggtattgtgcatccgcattcgtcgtttaaatttatttaatttaccggatttttccccaaacccataaaatttgttcgtatcacccatccgactatagtgatattcacgaccaaagtcgtctttcacaaacgcccgattaggcaaatcttggtgaactacccggccgttttcgtccacaatttcaaagtaaaatggctctttgaaaatatttaaaacatactttccgttagttacgcaataatgatccgctagctccgttacggtaatggaaatcggggacacccgctgccgctcatccccaagcagttcgtcggtcgcatccgcccacgccgtttttaccagcgcgtaagattgttcaggcgcaaaatcatccgcaaaagtccccttaatgcgaataatattttcatccaataaataaattcgaaaacgtgctccattcgtaattacatccaaaaaatcattttgattatttatttccaatactttagtgctagttttcattgcgtgccaccccgtcttcggaatattcatccggtatgtaatgtctcagttatgcacttactttataacctgatgaaagcgctgtcaatatcaaatgttttacgtgaaccaattttactttctccttgttttgcccgtaaaatcaatccttatccaaggcaagtgcatttttttgccaagttacctcgctttattgaaaacgctttctttaggtgctattcttacagtgtacttgtgaagtagtttagcaattattccaacttaattttaaggatgtgaagtacattggacaaaacccaaaaaacggtcaccatcgacgcagccccttttaacattaaggataaagtcggctacatgtttggtgacatcggtaataacttctcgtttaacgttgtcaattccttcttaatgattttctacaccaacgtgcttggtttaactggtgcccaagtgggaattcttttcttaatcgcgcggttcgtggacgcgttcgccgacattaccgtgggccggttggtcgataacagtaaattacataaaagcggccgtttcaaaccttggatgtctcggatgcagtatccgctcctcatctttttggttcttctatttgtgccggtagttaaggactgggcgttaccgattcggctcgtttttgtgttcattacgtaccttggctggggaatcttttactcctgcgtgaacatcccctacggttcaatggcggccgcaattagtagcgaccctaacgacaagacctccctttcaaccttccgggcactgggatctgcgttaggaagtgcgattaccagttacattatcccgctatttatctacattggcgctacccaaaagatttcggggacccggttcttctgggtggtcgtggtatgtgcttttctaggctggggctgttatgaattgaccattcacctcactaccgaacggattcggaccgaaaaaagtgcaaaagtcccactttctcggctagttcagggaatgttcgaaaataaagccttaattgttttagttctaattgatatcatgatcgtaattaaccaaaacctatctggaaccatgatttcctacatctttaacgactactttaaggataaggctgcaatgtcgattgcgttgattttcaactttgcgaccgtaattttgttggcgccgtttagcaatttccttaccaaacggtttgggcgaaaagaaacttccatcgtagcgctactctttggagccctaatgtacggcatcctactagttgtccacacccagagcactagcttctacctagttatgctgttctttggctcgttaggtgcgggaatgtttaacctaatggtttgggcgttcattaccgacgtaattgataatcatgaagtactaactggcgtccgggaagatgggatcgtgtacggagtcaactcctttgcccggaaagttgcccaagcaatcgcgggtggttttggaggatttatgttgaccttcatcggctatcagtcgtcaaccggtggtggtgcggaacaaagtgccacggtaattcaccggatctacaacttggcgacgggaattccaacggtgtgtttgtcagtagcggcattattgctactattcttctacccgctaaataagaagcgggtcacggaaaatgcaaggaagctggaagaattgcatgaagaaaacagagtgcggaagcctgcggataaggcttgaggatcaactggattagtcggctaatcgttgggctggcgattggacggctaatttggttgaccgcagagccttgaaggctggagcacattttggctatatagcatagtaataaaaccattaaaagctaaggcaccaaacgcataaaatgcgattggtgccttattttggttagccggaaggggttagggtgtggagtatgtatcacaatctcgcatcccctccaaaaaatctccaaacaaaaaagcgtggggaaaactaaagtaatgtttttcaaggatggaaagattcttaaaaatagttttggtgtttcggctttcatagagccaaaagccaatttgttccgcttaaccaaaaattgaccactatgccaaatttaggcataatggtcaattctcagttgatgcttgtaaactaccagatctttgtcccacgtttttttattttaatattgtgcttcgtatttcattacgcgtttaaccgcgaaagtgatcccgtaagagatgaacagaatcaacgctaccaataggtatggaatgtgggtattgtaatccatcaacattccggctaaaatcgggccgattacgttcccaacgctagttaacgacatgttcaatccgttaattaagccctggttatttttgccttccttagttaacaaggtggtgattgctggccgcaaaatgtcaaaggccgagaagactaccaatgtggcaataattacttcaatttgagtgtgcgcctgggtaatccaaaagacgaaaaccgctccaatgaggaagcacgctccgattaagttaacttcacccattttccgaaccagccaatcaaaaataaacacctgtaaaatcaaagaaaagattccattaaaggttaacaccaacgcaatggttcctaacccaaagttaaatacctggtttacgtaaatactatagatactttcaaagccctgaaggccaaacgccgccacgaaaatcatcgtaaataagatgattagcggtgcggttaagacgtcgcggagcgcgcccgtctttttaaccgcttggggctcatcgtcatgttcttcatgggcaatttcacgaataacttccattttcggcattaccacgtaagtgaaaattgtcgaaattagtcctagcgctgcagcggcccagaaaggcgttttatagctaatgtttgccaaaacaccgccaattccgggtccaaggattagcccgccgctaaaggccgccgagatccagccaatcactcgggcacgttgtgcgggcgtggttacgtcagcagccaacgccatggaagttggcacgaataacgccgctgacaatcccccaattacccgggatacgttaaaccagatcagcgaattagataacgcaaaaatcacttcggacacggcgtacaaaaataatcccgctacaatcaacggcttccgtccgatccggtccgaaagccggccaactaaaggagacgcaatgaattgcgaaaaggcaaataacgacgtcataatccccatttgagttgtggaatagtggtaatagtttttgataaagggagttaccggaattaccagcccgattcccaaacagatcaataggtttccagcgatcagaatccataaagtctttttgtttttagcatccattggcgctcatctcctttgcgtgttttcatattcttacatactaccacgaaataattttcctgtcttatcatgcagaatggtaattttggggaaaaccggctttcccgttcaaaaagagccgtgactaaagttggtcaccgctctttctttaaattgctatttaattaatgattaaatcacgtttcgttcaaacggttggtcactaatgccgtccgcaagaatcttcttagcccattcctttgcggagaacaacgagtggtcccggtaatttccgcaactgtaaatgtcagttcccggaacgtcttcccacttaatatcatttgcgattgcttctaaagaacccttcaacgctttggccacttccgtagtcgttggcgtaccccaaacgattaaatggaaacctgtccggcaaccaaatggtgaacaatcaataattccgtccatgcgatcccgcattaatccagctagcagatgttcaatagtgtgcaagcctgccgttggaattgcgttttcgtttggttgaacaagtcgtaagtcaaaattggaaatttggtcacccttgctgccttcttcaacagcgatcaaccgtacgtaaggtgctttaaccttggtatggtctaattcaaagctttctacttttgccatagaaactcatcccttcatcaaatattggttacatacctattgtaagccgaattttcctaaaagtcttccttttagaaatcatcttgcccaaggttgtgcaataagtggtgattgaagactaagcgttgcatcggccgtaagtgaacgactggcaagtagctggtgggaaccttcgcttgcattggcgcgtagctggtaacgtccttgtagatggaatacagcagcaacgtacacacgaatatcagtgggaagccggccaccgtacaaattgcttgaacgacttcgaatccaccgacgatcacgattcctagtgagaagaagataaatacaatgacccacgtcatccggttccaacgactaggctgccgtccgttagataagtccagactagtaaaggacgacacgataaatgcggaagacgaaatcgtggttgccaaaaagataaagcacgagacgcagaacaaaatcagcatcaatttattcattggcaaggtggtaatcaaggccgcttgcaccgctgcttgcccctgcgtatttaaaatgtgcacgatgttcaacgtaccggattgttgtaaccacaatgcgtagcccccgaggactgcgtaaaaggaaagacacccgccaactccataagtcatcattccaatgatgatttgccgaatcgtttttccgtgcgaaatccgggcaatgaacaagcccattaccggcatgtaagctaaccaccagccccagtaaaagagggtttgatgttgggcaaatccgttcgtaccagcattagccttgttaaaggatagcgccgtgaagtgttgccccattaattttagcgtctgtccttctgaacctaccaagaatttagtaggaccaaccaaaaggacaatcgctaagaaaatgattgccaggtaaatgtgccaagcagataactttttaatccccttgtttaacccagcgtaaaccgttagtgagaataaaattaatagaataaagaacaaaaacaacttcagatacaaagtatccttgatgcccacgataatactcaaaacgcgggcaatgaccgggatttccatcccaatcgacgaaccaatgccacccatgatgccaaacaccacgagaaagtcgattaattgccgtaatacctttttgtacagctggtcgccacgcaaaacgggaattacgatacttaaccgccgcaccggaatttttttcacgtacatcgtatagccaatcgcgattgtcgcggtcccaaacatcatccaagccatcgggccccaattaaattccccaactacgttcgcgtacgcaaacgccgctttggacaagggtttggcaccaaacgcggggtgttgcaggtattgcaacggatccgaggcactcagcatcaaaatgctggcatcaattgccgtcgcaaacaccatgcttccccattgaaaaccgctaaaatcgtgatcaggatcagctttgccaaatcgaatcttgccgtatttactaaaaatcaagaacaagaagaaaacaaagttgatcacataaatggaaatatacatccattcatatttgctggtaacgaatgacaacaacgcgttcattaattgctgaacggctgggccgcctacgatcaggattatggaaacaatcccgaataataccatcgttggtaaaaagacagctcgatcgacattcttactgtgtaagataaaaaattcctcccaatagttctaagactgcggtattaaaaaagcaacgcggctggcgtatttaatttacacctgcatagcgttgctcgatcggttttacccgaagttcgtcatacctgtcgtttattatgttactactaaattacaaaaagtccaaatttagtcgatagtcttgatgatccgggccggatttcctgcaattaccacgttatcaccaaagcttttggtgaccactgaaccagcaccgaccacgacgttgttgcccaacgttaccccgggcaagacggtcacccggccgccaaaccagcagctatccccaatcgtaatgggcgcgcccatttcaacgtcggcgttccgttggacgggatccaagggatggatcggcgtgtaaagcccgacattgggaccaaagtaacagtgctcgccaattgtgatggggcacgtgtctaagaaggtcatgtcgtagttgccgtaaaagtggttaccgatgtgaatattccatccgtaatcaaatttaaagtcactttcgacaaagaaatcgtcgcccacgtcaccgagcagttttttaaatccttgattacgccgctcgttatcaacttcttggttcagttgttgaatccgttgacgaataaatttccgccgttcaattaattccggatcaaactgctgatagggttctcccgccgtcatttttgctcgttcagtcttactcatctaacattccgcttcctcactcaatttgtttaaagcagtccaattttacgtaacccagcttgggcagccaagttaataaagttaaacggccggtcgtaatacggctggaatagcatatccacaaatgccaagtccttaagcgtattctggttttgaattgctaaagaaattaggttggccgactgtgaaacatcgtgtttgctatagaattgggcccctaaaattcgcaaactctttttttcgtaaaccattatactcgttattttagtggtcgacggcataaattctggacgatagttatcttcaaataagacataatctgcatcgatgcccgcatttaacgcccgttgataggttaaaccagtcatcgctaaggtgtgtccaaaaagggcaattgccgaggtcccctgagcgcccatttccggccactggttgccaaagatgttgattccagctaaagtaccctggcggacggcgttcgtggctaaggggatgtattcgggagcgttggtagggttgtaatgaatagtccgtaagtcccccgccacgtaaatgtcaggatccgagctttgcccatattcattagtgatgattgccccgcgccggtccattttcacttccccacgcaataagtcggtaaccggaacaaacccggtcgacaccaccgccacgtcggtagcaaactcgcggccatccgcggtcgtaaccaataactcgctgactttatcagtaaatgaaaccaccttgctgttgatttccaccttcacgtggtgatcattcaatagtttaataactttagcactcaacggggtgtccacgtaattatttaaaatatcttcgtggctttgaaaaagggtgacttcgtggttagtatccaccaaactttcagccaattcgacgttaacgtaaccgccacctactaaggcgactcgccgtgcatccttcactttttcgtgcaaaagttgcgcttgctcatagtttttacataacattacccgtgcatggttaactcccttaatgggcggtaaggacaccattgaaccggtacacataataattttgtcatacttttcccgcttaacggtgaaatcatccatgtcttgcaccattaactcttttttctgccggttaatccggatcacgtcatgacgcagatttacgtgaatgttttcggtacggatgtcttcggcactatcgtaaaacatatcttcaagttgcttaacccggccatttaaatacaaggcaatcccacaggaaagaaacgaaatgttatcatttctttcataaatatttacctcggtagtgggatcttgtctaataatttcacgaaccgcagcggttccggcatgggtacatccgataattgctactttcatttttcctcctaaatggtctatactatagacagttttaatattcctaaaaatctattcccaaaagttatcatttcataacaaaacaattataatggttaatttacgatacatcaaaaaagttgtatggcgttaatttttttgcatcacaattcaaattcgaggagtattgtctttaatgtttagattcttcatccaaccacaattgaataccgttgcgcaatccgtactaggttacgaactattaattaagcagtaccgggacggcgcttggcgaatgcccaaatcattttccgcgattcctgccaaaacgatggccgataccctaattgccacggtaaaagaactatcgttaaaggtcggctcagtctccgtcaacgttgaccgccatcaaattcaagaccaacatctcattcatgcactcattatggcccaggccgttttacgaccagtcaagctagttattgagctaattgaagatgcagtaaatcccgcggtaactaaccaagaactgattcctacggtacaaaatttgaatgatttaggaattcaattttgccttgacgacgtgggtagcggaattaacacttggccagagataaaatcactgttgccttatactagtgaactcaagtacgctttacaaaattataaagagcacttgagtgaaaccaacgccgaacaccacgttgcgttctggcaaaaaatcgccgctgagcataagatgcgctttattcttgaaggcatcgaggatgaccaagacgatgcttgggcagaccgaatgaaaattgacctacgccaaggctattattatggcaaaccagccttgatgaaaatttacgatagcgaccccgattaaaaatattaccaatttcgcatagtttactataattagcgaggtttttaacccattatgcttattaacctgggacagatgccgggcaactggtaagcattaacccagaaacgaccattacgcctaaatttggcataatggtcgtttttgggatacgcgaaaccaactgactttttaactcccatttttgtttaaaagaactgattaaaaaaggcgcccacagatttttatctatggacgccctttgctttaaactagtgcgattcccgcacttctagcaaactaatcactattcaatttcaattcctgaactagaatcatcattggtctttggtagtgtaatactcaacacaccgttatcaaccttagccttgatatcgcttgccttaacccctggcaaggagtagcttctgtgcatgattccgtagttccgttcagtcatggtaacgttatgttccttgtcttcatgatctgcgaaactatctttcttaacttcaacattcaaaacaccatcttggtagtttagcttaatgtccttcttgtcaatgcccggaacatcaatcttaacattgtaatccttgtccgattcactaacgtcagtctttaagctagttggagttgcgttccagctgtcgttgaaaaatccacgtgctaaacggtcaaagaatggatcccacatatcattcctacgattcatcatttcattagccataaaacaaaacccctttccaaataaccaaaatgatcgatgaggtttttgtttacctcatctcttcactttcttattgtagtgcattggttaaagaaagtcaaactttttatttgactttctttgaccaaatttattttgcaaaaaacgccttgattttgcaaataaaaagcacttgaggttaattttctcccgctccactgctatatagtcgaaacgtgttttgaaatccagctctctccggctaactaaattagggaccaattgcttaacctgcaattagtcccctaacgtcctattgttatgtagtcgaaacgcgcgacagacaccaattttctcccgccccactgctgcatagtcgaaacgtgttttgaaatccagctctctccggctaactaaattagggaccaattgcttaacccacaattagtcccctaacgtcctattgctatgtagtcgaaacgcgtgaaagacaccaattttcttcggttaactaaattgtgccatcaatcgctcaacccgcgattaatggcacaattctgttaagcctcaaaaattacccggtgtctgtcacgctctaatttctttccggaaaccaaatcttaatttctttttctgcgctttctttactatccgagctgtggaccacattcttaattgagcctggtccccatgcccttgcaaagtcgcccctaatcgttcctggcattgcttcacttggattcgttggtcccgccatcttccggaaagtttcgataatttcatcaccttccgcaataatcgctaccaatggtccactcgtcataaattcttcaattcctggataatatggtttatccaccagttgggaatagtgttgccggagttgttccttagtcgcgttaatcatcttcaacgccttaatctcataacgccgattttcaattcgggaaagcacgtggcctacgtgtccacattgcactccgtctggtttaactaaaatcaaagttctctcttcactcatatgcgcatcccccttggattttcataccctaattatatactagggaacgtactcgttataaatttttcgctcaccaaacataatttttatgggtttattaagaaacactaattttagcacttcatgatcttggattgaagttggtttgaacttcattttaaagccgttttaactaaaaagctgggcaaaaactaaaaaaatacttttcaaggatgaaaaggtccttaaaaagttgttttaatgttttggcttcaatagagccaaaacgtgtgccaaaagtcagttttttccgcttaaccaaaaattggccatgatgccaaattcaggcatcatggccaatctccagttaatgctcgcaaaccatccgacttttgtcccacgctcttcttaatttacatcatgctatcttcagggctccgaccggaacttttgaataatcgtaatcgccacaatcactagaattgagccaattaattcggtgatgttgaacttcaagtttaagaacaacaagcttagtacaaaggtcactaccggttgcacagcatccaaaatgctaaccactgccgatggagcaaagttcaagctatgtaacaatgcccagaatggcaagatggttccgactaaaattacggtagccattgacaataccaatcgcgtcgtaatttcaggggtgttaacccataccggttggtgaatattgaacaaaattccgccaatgattaacgcccaacccaagacgatcattggagaatggtctttggtgattggcttaggcaaaacaacgtaaaacgcggccgttaccccagagagaatcccccagattaaagcactgtttgaaattgctaaactatgaatattgccgtgggtaatcgccaagaatacccctaacatggcaatcacgaacgcgattaaatcactacgcatcggccgttcgtgtttgaaaaccagactgcccaaaacaatgaacagcggacttaagtattgtaaaatcgtggccgcagacgcgtttccttcctgcacactcatgtagaaggttaataaattagccattaaaccaaaaattgcgtaagcaaataaccataaaacggttcgtaatgatttaaaaacgtcaaaaatgtgcatccggtacttgataaagctgataatgagtaagagaactcctgctccactcgtccgtgctgacaaaaaccacgaagccggaatactttctccctgagagattacctgcaataccgtaccagaaattccccacatacaggaagcaatgagggcccaaaaaattccttttcccacctgcttgtttgtcaaattattctccatctcagtaacctcaccaacatattaatttgcatattactcaagattatatctaaaaactattctcttagtaaagaatttcgtcttgataaataaaaagacaggacctctgccctgctttttacggtagcttttagttaatcttccatcgtgtctttaataacttcaacaatcttattgatgtgttcaagtgtcttcaagaaatcgtccttaccgtaacgtttagccacgtcatctaacatttctttgaagatcttatcatttttccagtataattcacgaccgcggttagttagcgttaaatacttcttccgccggtctacccgatcactcttttgttcgattaaacctaggtcaagtaaagttcctactttacgtgagattgcactcttcgttacttcttgtgtctccgcaatttcactcaaagtaattggttcactaccagattgttcgattatatgcatgatcataaacatatcaaaagatacttgtggatcagagattttactttctagcaacgttccaatcaacttgatactcttattgtatgcttgtgcaataaatgaaatatctgcctgttccattgtttctcctcttttcttcctaactcgctaaaaccttaaacactattaaattttaacacactaataattatagtcaaggcaacgcttaaaatgttaacacataaaccctatactttacaatatattacggtgaaaaagttgtgccctcgaacttaatctgcacggtataattgttcaacttgttgttgaacgacttcgtgctgtaaaaattcgtcgtaagtggtatctgcccgttctaccactccgcgatccgacacttcaataatgtgatcagcagtcgtttgaataaattcatgatcgtgagaagtcataatgatggaactcttaaattcggttaacccttcgtttagcgcggtaattgattccaagtcaaggtgattagttgggtcatctaaaagcaaaacgttggccttgcttaacatcatttttgaaatcatgcagcgaaccttttcgcccccggaaagtttcgttacgtttttcaacacgtcttccccagaaaagagcatcttacctaagaaaccgcgtaagaaagtgttgtcactctcttctttgtcagcgtattgccgcagccactcaagaatgtccaagttttcgtcagtaaagtacggattaatatcgcgaggaatgtaactacgttcagtagtctgtccccaagtaaccgaaccttggtctggttctagttcacccgccaggatctgcatcatcaccgtggttgctaagtcattgcgacttaagattgcggccttttctccgggacgaattgtaaaggtaatgttatccaaaatctttacaccatcaattgatttgctaaccttatcaacccgaaccaagtcattacctaactcacgagctgggttaaaccggatgaacggatatttacgcgaggatggtttaatgtcgtccagcgtaattttttccaactgcttcttccgggcggtcgcctgttttgatttcgaggcatttgcgctgaaccgtgccacaaattcttgtaattgcttgatctgttcttcttttttagcgttggcgttttctgctaaccgcttagcaagcgcactagattccatccagaaatcatagtttcccacaaacaattcaattttgccgtaatcaacgtcgcacatcatcgtgcagaccgagtttaagaaatggcggtcatgggaaaccacgatcacgatgttcggaaaatctgccaaaaagttttctaaccaactgattgattgcggatccaacccgtttgtcggctcatctaggatcaaaatatccggcttgccaaataacgcctggccgagtaacaccttgatgcgttggccttcagtcagctcactcatcttgctgtaatgtaattcttcgccgattccgagctgttgcaataattgggaagcttctgcttcggcattccagccgtccatttccgcaaattctgcttccaattccgcagccttcatcccgtcttcgtccgagaaatcaggcttagcatagagcgcgtccttttcttgcatcacttggtacaacttttggtgaccttgaataacggtatccattaccgtaaactcttcgaacgcgtagtggtcctggttcaaactcgacatccgttcgttaggcgaaatgctaacgtttcccgacgtcggttgtaattttccttctaaaattttcaaaaaggttgacttaccggccccgtttgcgccgataatcccgtagcaattgcccggggtaaattttaaattaacgtcactgtacaattttcggtctgaaaattgcatgctcatatccgttacagttatcattgatttcctccatatactaacaaaaggcaaaaataaaagagagtgggacaaaagtcggtatttacgagcattaactgaatcccccattaatcgcaatctaggcggtcgatgggggatttggttaagcagaacaaactgacttttggcacacgttctggcactgctaaattcaacagtccaaaatggtttcccagcctcaatatccttcaatctttttaatctaacatacctaccatatccgagcaactttcttttactgaagctgtcgcatcggcttggttaagcaggtttacttattttttccggtggacattaccaaattcaaaatgattgccaccatggccgcaaccgcaattggcgagcctagtaaatattgtaccatctgaggggcttccttcaccaccgttgtgggaattaatactagcgcgaagatcaaaacaatcggaatcccaattacgtatatgtcaccatctttttcttggaggttacggataactcgcaagccgtttagcataatggttacgcagataatcgcaaacacgccgccaatcactggggctggaatggcggatagaaacgccgaaatcttagtaaagaagccgagcacgatgaaccagattccagctgaaatgaacacccgtttactggccacaccggtaattgaaataattccggcatttgtggaataacccgttacgggcgtagatcctaatagagcagcaattagacaactaattccttccccaaccaggccgcggttccactgtttgttggtaatttgatggttagtaaccgcccccatcgcaaaccaagttcccgttgtttcggtcgttagaatcgcgtaaataatgataaaagttaaaattgcggttggtgaaaaggtgactccgtaatgcaagacggtgccttgcggtaagctaaaccacgccgcttgtttaacggtgctccagtcgaagcgtcccatcatggttgccgcaaccgtaccggctaataacgcaatgatgattgctccagttctaaaaatcctttgtaaactaggaaagtgaatgctaattgaaatcgaaatcaagagcgtgactgccgtaattccagctaaaattatgttttggttgatgttgccgctagcttgaaaaatattactgtttaacgcagtgggaatcagcgatagtcccacgcaagttatgatggtgccacccacaagcgccggcaccaaagtttgaataatcttgtaaaaaacaccggatattcccaataatacaagcaaaattgctcccacgatgagcgctcccagcaaggtagccatccccttttggagcccaccactagcgaggacaatccccgacgctgccgtcagcggaacaaaagaaggtccttgtgaaattggcattttcatgaaaacagcggtttgaatgatggtcccaattccggctgctaagaaagccacctgtaaaagtcccattttttcgctaaaggacatcgacaacatcattgctaaaatgaccggcggaacgtagacgtccattgccaaaacgtgctgtaatcctaataaacttgcctcaccattgccaattttatcgtcgggcccgataaataagttactatgtttttcttccattattgaaatacttctcctatgcttacttttgactaactaaatttccagcaatcaatactttcgaaatatcgtctgggttagtttgatacattaaccttgaaaaaatatctgtcggagcggttgaagaaatctccgccaagccgtcccttacaatttgcaaatcagcgtaacatccccgcttgatctgaccggccgggatgtggagcgcgcgggccccgttgaccgttgccatataaaatgcttgcgctgctgaaatccgcgaattagctacgccccgctgctcagcagtcacccggttatctaccccgtcttcaagcattctagcggaaataattgcctgttgaatgtttcggtaaatgctagcagaaaaaccgcctgaaatgtccgaacctaacccaaccgttattttctctaaaatttttctgaccgggagtaccgcatttccaaagtaggcgttagaaatcggacaatgggcaatggcggcgtgagtctgttggaaaattgctaagtcagcttctcctaacaacgtcccgtgcgccataatcgagcggtcggtgagcagatccatttcctgaagaacttttgcatctgatttaccaaaccgttccattacatagccgtgttcccaatcgctttcactgcagtgggattgaatcagcaaattgcgttcccgtgctaacttgcctaactccagtaacgtttcatccaaacaactcggaataaatcgcggagtgaccaccggaaaaattggtgcttttgaaaacttttcttggattttttcaataaaattgaccgtactatttattgctgttttggtagaagcattgcggtagtaggctggggtttgctcagggttatccattactacctgaccaataaacgcccgttgcccgagctggttgcattcctccgctaaaactaagtttgctgcttcatgaattgtgccgaaatacagcgcggtagtggtgccgttattaactaaattacgcactaagtggtgataactttttctagcaaaatctgtatcttggtacttggcttccaacggaaaagtatattcgtctagccattcgttcaatggtttatctaacgccatccctgcttgcggccattggggagcgtgaatatgtaaatcaataaagcctggcaagaggtattcatcgtcggctaattcgattaactttttagcggtccgagcttttactaaaagatcgcgatatttgacctctttgggcaagacgatatcatcaatcattcccttttcgtcaatcaccactaacgcgtccttaacaaaattaactttttgggttgattcagccgaaaagaaggacccttaataatttttttatagttaattatccccactccctttcattctttttatattatcacgaaacatatttaattaaaaacggtttttatgaccgattttaacgaacattattttcaaaagcgcaccaaaaaaggccaggaaacaaatttcctagccttaagtcagagccacttacttagatttttaattttattccgttgccaaagcttccaccggatccagtttagaagccttacgggacggcgtaaaggccgccaagaggctaattaccacgctgataatcactccaaaagtaatgtatcccggagtaattccgatgatcgcaaagtcaatgtgtttctgtgacaactggttggcaccccattgagctaacaaggcgagcaccgaaccaagcacactagagaacaaaccgaggaaaaaggcttcggaaacaaacaagttacggatgtcttttcgccgtgcgccaattgcccgaagaatcccaatttctttggtccgttcggcaacgctaatgtaaagtaccacgatgatcatgattgccgaaactagtagtgaaattcccgcaattcctgctagaacgtagaaggccagcataatgtaggtgtttaacgagtctaggattgctcctacgccggtaattgcgtaggttgcccgttgcttgcccttcacctgatgcttataacccttaatcttgttttgaacgtccttaacgttcgtaacttgatcaacgttaaccgtgaggaagttagggctaaaggaaagcttttggtccgtaaacatttcctttaaagtgttgtagttaatggcgctggtcccggacgtaattacccccgaaaccgtgacttctttttgcaattgcaccggccgtttttggtcatcaacggtggttacaaaaatggtcacttttttgccgactacgtttttgtaatgcttgtccaacttcttcgctgacgccttatctaacaagatttcatttgcgtgtggcaagtgtccgtatttaatgtcgttgacccgctcagtcttattccaagtctgtaaaacttgtaaggtcgttgacttcttttccttaaccaccttagccgattgcagataataaccgcgttcgaccgacttaacatggtccatcttctggaagcggcggtaatccgcatccgccatcgtgattccttggccatcttgcatttgttcgggagtggcatttttgctaacctgcaccgcggtcggattaatttgcgacgaaatctggtcgttcatgtacccagtcaccccgttacctaatcccagcattaagattaccgaaaagatcccgatcgaagcgccgaaaataatcaacaggttgcgttttaaattgtatcccatgtgcttgagcgccatttgtaacgcggccccaaaggtcaaatgcttgggctgaaaacctttttctgccgcaggaaccggataaggatcccgcaagttagcttcaccatggatcaccccgtcatccaaatgaaccactcgggtaccaaaatcagctacttcttgagaatgggtaaccgcaattactagtttgccatccttagcaatcgatgccaaaatttcgagaacctcttgggtattttgactatctaaagcaccggtgggctcgtcggcgatgatcacgtccggatctcctgctaaagcccgggcaatggcgacccgttgcttttggccccctgataattggttaggatgtttccgcatgtgctctttcagccccacccgggtcaacagttccttagcccgggccactcgttgagcatgggataacgaggtcatttccaaggaaacgagcacgttatctaaaatatttaggtgactaatcaagttgaaactttggaaaataaagccaatgttttcccgccggtaagcgtctaacaccttgggctttgcggaatgaagcgattgaccgttgtagaccacgtcgccttcgtactggtggtccaagcccccgataatgttcatcaaggtcgattttccgccacccgattcacctaaaatcgagacaaattctccacgatcgaatttcaagttaatccccttgaggaccttgaattcttcgtcgcctaaataataagatttatgcacgttttggacttcaagtaaactcatattttctcctcttacgatctatattctgcaagttagtctgcatggacttgcttaaagtgtcccgggtggaagtacttatcaacttcggtcaccacgaggacaacaattccagccacgaccggaatcaaccattgcatgccgctcattgccgcagtgctgaagattgcctgcatgaacggtaaataagttaatcccaattgtaacactaatagaaccccgattatccaaaaaatatgccaattacggaaaacatccgtagaaagtgctggcttcggtgttcggatattgaagaggtagaaaattttaccaaagacgatgatgtttactgtcaccgtgctagccactaattcgctgattccctgaccacggagccagtcgaaaccgaccattcctagtccggcaattaaaatcgaaacgtaaataatttggattacatccgcccggtttaagaacgcccttcccgctggacgcggtcgccgttgcataatgccctcttctgcgggttcaaacaagaaagcaaattgaatcgtgattgccgacaccatgttaatccagagtaattgggtcggtaccaacggcaattcctgttggctaatgatcgataggagcacgattaacccttccgcaaaactagttggtaacaagaagcggatcgtcttcttaatgttgtcgtaaacccggcgaccttcgcgaatcgctttggaaagggtcgcaaagttatcgtcggtgagaatcatatcggccgattcctttgccacgtcagttcccttaatccccatcgcaattccaatgtcagcgcgtttcaaggcgggcgcatcgtttaccccgtcccccgtcattgcggtgaccaatccgttagcttggtaagcttccacaatgcgtagcttattattcggcgtggttcgcgcaaaaacgttatagttttgaataaccttttgcaaggtttcatcgtccaaacggtcaatttctgcaccagtaattgccctaatttggtcgtccaaccctaatttttgcgcaattgccgtcgcagtttccggatggtctccagtgatcatcttgaccttcactccggcatcccgcatgtcgtgcaacgccgcaatcgtttcttctcgagggggatcaattatccccgccacccctaaaaattgcattcctgtttgcaaatctgcatgggttaaggtggtttgctctgccggagcttccttataggcgaccgccaccacgcgttgccctttttgtgcaatttgggagacccggtcgtaccactccgtcaagttaaaatcgggatcgtccttaaccatttcaaaaagtttgtcaggagaaccctttacgtaaatcaatttttcgccagttgcactctgactcaactccgcgatgtagcggtagtccgagtcaaacggaatcatgtccacttcggtccactcgggaactcgttgctgaaaggctttgttcgccaaggtcaaaaaggccccgtcggtaggttccccgttaatttgccactgaccatcagtttgcgttaattccgtgtcgttagcgtagtaaccagccaagatcaatttttgtaaatccgggtgttcggatagttccaccggctgaccattcaaacacaccgtgccttccgggtggtatcccgttcccgtaacttcaaattcgtgttgtttagtaacaacggattccaccgtcatttcgtttttagttaacgtcccggtcttatcggtggcgattacgttcaccgagcctagcgtttccacggctggcaaggactttacgattgcgttttgcttggtcattttgttaattcccatagctaaaactaccgaggtacttgcgggcagtccttctggtagggatcccacgatcatcgtgatcaacgcaatgactaaaacaggtaacgagtagattttagtcaggtagccgtaaatccccactaacatggctacaatgacgattccgtacgaaatgtactttcctagtccgttaatttcccgcattaacggagtggttttactcttaacggtcttgacgctggaactaatttgaccaatttcggtttgttccgcggtggccaccacgattccaagaccgctcccgttagtaaccgcggtcgaagcaaacgccgagttagtccggtctcctaagggagtttcttccttaagcgccgtaggagtttttaaaacagaatctgcttcgccagtgagcgcagcttcttgaattttcaagttatccgcgtccacgatccggagatctgccggcacgtggtcccccgcctctaaaaagactaggtcgcccgccactaggtcttcagcgggaacgtcaagtcgttgcccatcgcggaccaccgtagcttccacctgtagcagctgtttaattttgtccaccgcgctggaagcctttacctcttggaaataaccaattagcgcgttaataattaccaccattccgataacgatcgaatctgaatactctcgcaacataaaggtggcaattgcagcaacaatcaaaatgtagataatgctgttgttgaattgctttaaaaaacgcgttaaattgctggtcttcttttcggtcaaagcgttgggcccgtccacggctaagcgtcgttgggcttccgaggtggtgagtcctgcctcggaatcggtgcggagaatttgagcgacctccgcagtagttaaacgataaaaatgaggcgagggagagtgacccgcgccatagtcatcggatgtggatttagtgtgcataagcgcctccttagatttatagatagtttttggtaattaaagcatagcaaaggtgggtgggggaaggaaagaaaaaggctcagagtgttttgcaccccgggtagctcttgaggactaactgaatctcgtcattaatcgcgggtttggcgattgatgtcgggattgggttagccgcagagggctgggcgcaaaacacgtttcgactacattgcaatagaacacaaaaaaaacgagccaagatttctcttagctcgttggttaaattcatgtatattttaaagcgtccggcgccgaagccgattttctagtgcaccaagcaccaaatcaacaatgatcgccattaaagcagttggcaacgctccggcaaggataatcgcgcccccgtttgtggcgttggttccgcggataataatgtctcccagaccaccagcacccacgaaggttccgatcgcggtaatcccgattgccaataccatggcgttccgaatcccggctaaaattaccgatagtgatagtggaatttcaatcatccaaagcacttggagtttggtcatccccatccccttaccggcatcgaggtatgcatcgtttacgttcaatatccccgtataagtgtttttaatgactggcagtaaagcatataggaagaccgtcacgattacggtagatactcctaagcctaacccaagcattaaaatcgaaagcatcgctagggatgggatggtttgaattacgtttgccaaaccaatcacccaatcactaatctttcggtttttcgcgatgaaaatcccaatgggaatccccacgattgccgctaaaatgaccccgtaaatggaaatcaaaaagtggcgactgaattccgaaagcacgtacattccattatgcgagaagtaatagaacagttgttgccaaatattcatactttgcattagtgcttccctccttcaaagtagtggtgcgccttaagaaattcgctagctaccaccgatggttctttcaaattgttatcaacttggtaattcaattcttgcattgtttccaacgaaattttcccgtctaacttgtgtaaaacgggtgctaattgcggatacttcttcaacgccttgttattaacaacgacacttgcgctgtacggcgggaagaattgccggtcatccttaatcaatttcaaatggtagctgcgtacccggccgtccgtagaataaccgaggactgcgtccatcttgttgcttgctagagcattgtagagcaatcccatttgcattgggtatacgtgtccaaactggaagccgtaacgcttcttgaagtcttcgtaaccgtcaccctttcggcttaaccaagtttggtcgattccgaccttcattttaggagcaattttcttcaaatcactgaccgtttcaatatgatgtttcttcgcaaagtcctgcgttaccataaattggtaagtgtccgcgaacccgtaagttgggaagtacgtcatgtcgtaacgccggtcgaattccttgtttacgtaatcgttcactgcttgcggcgacttaccttggggaccgtgcaaaatggtctggtagtcggttccgctaaagcgaatcgaagttaaatcagcttcatcacgtttttgagcttgaaaactaaccgttcccgagcccaagttgttgattacttccgcatttaaatttgtatcatgttcaactaactgttgaatcattgcgcccataatttgctgttcagtagtattttgggctgcaatccgcaccgtatctcccgaggtgccgttcaaaccaggccagccgcagcccgaaagcattacggttaacacgcctagcggtaggatcagcttcagtaattttttcaacatctagcccacctcctgcgttgttttgggggttagtttggcttcaagtttgcctaaaaggaaatcggcaactaatgccaagataattaccggaatcgatccgcctaagatcaagtcggaacggtataagttcaaaccgttgaaaatcaagtcacctaaaccacccgctccaatataggaagctaacgccgtccaggcaattacgtaggttgctgataaacgaacccccgccataattaccggaagggctaattgaagttccactttccacattcgttgaaaactgttcattcccatcccctttgccgcatcaattagtgcagggtctacactggttaaccccagataagtgttccgtaaaataggtaataatgagtaaatgaatagtgccacgatggccggagtggacccaattccaaaaattggaatcataatggccaacaaagcaagtgctgggatggtttgcatcacgctggcaagtccaattaccgcccctgaaattttaggagcccgcgtaagcagcatcccgaagggcaccgccacgatgatcccaagcgcaagggcaaccgctgaaatataaatgtgttgtccagtcttgctaagaatgtccgcaccgtactgatttaagaagttgatcattattgatcaccatctttcttagtagactcctttgtggtttgacttgaattgtttccgtccgcaacgattgaatcatcggtaaagagtgcgtcataaaccacgtctacgagggtcgcacgggtaacgataccggttaaccggcccttcttgtcaactaccggcacgttccggaaaccacgttttaaaatacgatctacggtgtcccgaataatggaatcttcgttaacgtaaaatacccgcggatccatgatttccccaacggttttgccagaatggtaatattcgtcaaccttttcgatgctgacaattccctttaggcgttcttcggcgtcagtaactaatagcgtatcaactcgccgactgtgcataatgtcaagtgcccgcactaccggctgatcaatagcaatcgatgctggcttattcgccacttgcccaacggtcgtgatacttggcttagcttggatcaaacggtcttgtccaattaagttagccacgaaatcattggctggatgacgtagaatgttttcgggagtatctacttggacttgctttccaccggtcatgactacgatccggctggaaaggcgtaatgcttcatccatatcgtgggtaacgaagatgaaggtcttacctaaccgttcttgcaagtccttaacgaggtcttgtaaatcttcccgagtaatcgggtcaagtgcgccaaacggttcgtccattaaaataatgtcttgatccgctgctagcgcccgcactaccccgattcgctgttgttgcccaccagaaagttgggatggataacgatccaaatattcttctggcaaatcaaccagtttaatcatttctttagcccgctcattgcgtttttcttcgggccacttcaataattttggtacaagggtaatattttcccgaatggtcatgtggggcattaacccaatattttggattacataaccaatcttacgacgaagtttaaccggatccatcttggcgatatcttgcccattgattttaatcgtccccgatgtctgcttaagcatccggttaatcattctcattgtggtggtttttcccgaaccggaagttccgataaagcagataaactcacctttttcgacgtttagattaaagtcatcaacggccactttgttcccaggataaacctttgacagatggctcatttcaagtaacatttgtatttaaacatctccttatttgttctctaaaacaacttagtttccatacattcggtctcagaggcattgggtgctactataacatatataacactttcttgtacaatcgcgccagtgtaggccctccagctgtaaccgaattctttattgttttaatgaggattaaaacttgttaaaagaaatagatgttgtaagatagtactataaattaaaaggagctgagaaaaatggcaaaatatgaaacattgcttccccgttttctaagatatgtaaaagtaaatactcgttcaaaccctaattcaagtacagttcccaccgatcctaaagaagttgaattcttaaaaactttagcaaaagaattagaagaagttggcgtagtggacgttcacacccaaccatcttccggttacgtagttggaacgttgccagctaacgacgatggcaacactcccgtaattggatacatttcacacgttgatacagctgatttcaacgctgaaaatatccaacctcaagttcacaaaaactacgacggtgaatctgacattgacttgagtggcgacggcaagtgggttttgaaaccttccgtctttccaagtttgaaaaagtatgctggccatgacttagttaccaccgacggactcactctgttaggtgctgacgacaagtctggagttgccgacatcatgaccatgttggactactataaggaacaccccgaagtaaaacacggtgaaatccggattggatttgcccctgacgaagaaaccggtactggtgcagatcatttcgacgctaaggacttcaacactaagtacgcttacaccgttgatggcggcccccttggcgaacttgaatacgaaactttcaacgctgcgcaagcaacgattgagattcaaggtaacgaagttcacacggcggttgctaagggactcatggtcaacgctttgcaagttggaattgactaccacaaccaattgccagaacatgatcgtccagaagaaactgaagaccgcgaaggcttctaccacctcttcaagatgactgggacacctgaccacgctcagttagtttacattattcgtgatcacgaccggcaaaagttcgaagaacgtaagcaaaccatgaaggatattgctgaaaagatgaacgccgaatttggtgaagaccgggtcaacgtggaagttcacgaccaatactacaacatgcgtgaaattctcgaaaaagacatgacgccagttaacatcgctaagaaggccatggaaaacttggatatcaagccggacatttaccccgttcgtggtggtacggacggttctaagatttccttcatgggaattccaacccctaacctctttgcaggtggcgaaaacatgcacagccgttacgaatacgtttcggttcaaaccatggaacgtgcggttgacttgctgttagaaattaaccgtattaatacagaagaaaacaattaatttttaaagagtgggcaaattccgttagccaaaaagactaggaattggaacccgatttgacattaaggactgtgacaacctcgttgtccagtccttttttaatagaaaaggagcttaattatgtcactgacaatggcgattattggatttggtaaaagtgccaaccgttaccacatcccctacattaaagaacgcgacatcaaaattaaatacatttacaaccaccggcgtcatccggaaaaagagcaaggattttatgatcctaacaccgtctttaccgacgaccttgagcaggttttaaacgactcggaggttcagttagttacggtttgtacgccgccggccacccactttgaatacggaaaatctgcgttagaacacggcaaaaatgttttaatcgaaaaacctttcgtagccaaccaagccgaggctaaagaactttttgcactagctgatgccaaaaaattactggcgatgccttaccaaaaccgacgtttcgatagcgactacttgactctcaaaaaggtaattgaacgcggctacgtgggccaacccttgttgcttgaatcccattttgataagtaccgtcccgatgacagccttcatgaaggttcccaagtcgatggccaattttacggcttgggcgttcacatgcttgaccaaattttagggctttttggcaaatctcagacagttaactacgatatccgggcaattcaaaaccccgctagttccgtcgatgatttttacgaaacacagctattctacgataattttaaggcgaccgtggtcagcaatccgttagccgcgcgtccctaccctcgtttcttacttcacggaactaacggaacctacgtcaagtacgacattgaccagcaggaaaacgacttaaagcttggcatcatgcctggcgacgatcattttggaattgacgctcctagtcaatttggggtggtcaagtataaaaaccagaatggcgactggattgaaaaacaaattcctaccattaatggagattatggtcgggtttacgactccatcgccgctacccttaccaacgccgaccctaaattagtttctaacgagcaagccttgtggaatatggaaattttagaggcggggatcgctgaaaagggtcctcacctttatcaaatgaagtaaattaaaaccgttaatggttagggtaagccggaaacttgcccgcaccttaactgacttttcaccctactaaccaaaaagagcgggaccaaagtcggatagtttgcgaacgttaactaaaaatcgaccgtgatgaatttacatcacgatcgattttttagttaggtgggttaaactgtcttttggtacacgtttttgacgccgttgaaggcaatccaccccaacagctctttctttaagaatctttccatccttgaaaagcatttctttagtttttcccgtctttttaattttttcctcattaggctactaaaaagcgcaaaagttttttacgacctaattattttacgcagtagctaccttaaactgttcgttcacgtacttagcgtacattgggtgggaagcaactaactcttgatgcgttcccgaacccgtaatttgcccattttccacaaagtaaatttggtcgctgtccacgattgtcgacaaacggtgggcaattactagcgtagtgcgccccttcattaagttggctaaggcatcttgaaccttcatttccgattctgaatccaaactagccgtcgcttcatcaagcattaaaattttcgggttccggagaaatgccctggcaatcgcgattcgttgccgctgtccgccagaaatttttacgcctcgttcgccaacttcggtatccagttggttaggcatttcttcaacaaatttccttgcatacgctaaatctagcacttcccacagttgctcatccgtaaagtcgtcgtccaaaccgtacgtaaggttatcacggatcgtccccgccatcatggccgaatcttgggacacaaatccaatttgtttacgataattagttaaccgaatgtcttgaatattagtgttgttaaacttaatttccccgtgcgttggttcatagaaacgttctaacaagctaaaaatggttgattttccgccgccagaagggcccgcaaacgcaatcacttggttaggcttagcctcaaatgaaatgtcttttaagacttcttcttcaggagcatctgcgtaagcgaagtcaacgtgttccaccgttaaatctttatcagccaaatctaacatttcaccatgattgaagtcttctggtacttcttccaacaattcttcaacccttcttgtggagccagaagctttcgccatttctgaaaatagtgttgcaataattggcaatgcctcaatcaaattaaacaagtacatcaaaaaactcattagggtgccaattgacatcaccccaattgcaattcggtgaattccatacgccaaaagaccaaagatcatgctcatgaaaaccatcatcataatgggctgcatcgccgcatcaaaaacggcttcttttttcccaattttaaacaagcggttaatttccttatcagcgtgttcttgagcttggttttccgcgttagaagtttttaccaacctaatttcactgagcgtttcgctaacaatcccgttaaatagtgctagcgcgtcttgccgtacgtggccgaccttcgtgccaaatgccattaccggaatcattaaaatgaccaccacgggaacggcaattaccattgctaaggtcatatgccaatccatccgaatcatcatgtagacggtccctaccacggtaataatgctggctagggtttggggaaaggtaaccgccaaaagctgtttaacctggttggtgtcgttaactaaccgactcgaaatttcgccggcctttacggtatcaaaataactaacttttaggagggtcaacctttcccacaacgttttccgtaaattctggatgacgttttccccaaagattccgagaatcgtcccgccaatcgccgaaaaaattgccgaagccacaaacagtaaaaccacttttgctaatagcgagtaatctacgcctttagtaaagttattaactaacgtggaggctaacttgggcacgtagacttggacccctgaactaattgctaataaaattacccccaacactaaaagtaggtacttaggactagttttcttaatcaacccgaaaaactgtctaaaattaaatttagtacgatctttacggatcgaatcgttaaagcgtgcgtttgctgccaattttagcgccgtcctttcttccaatcatcaaaaccaccaaagcccctgaaatcgtcgggacgcattcttccgaaatggttatgccgaagcatttgttcgcgggctctttcaaaatgcgggctcattttgccaaattgttcccaacgacgatcgttgctgaacacttcactaaatttttctttgaattcatccccgtccatgttttcaaccatccgttttaaatagtcagccaaattggttaactcgtcgtccgaaaagtccttaaacaagacgtcttttaaagtccccccgatggattcgtgagtttttaagctttcggttcctttatccgtaattttaatgatggttacgcgagaatcgctaggcgatttttcgcgaactacggtaccggctcgttctaattttttaataatctgggttacgctggacggtttgatgtctaagaattctgagatccggcccgcagttacgttttcttccttagctagtagcttcaaagtttcgaacgtgttatccgttttttcttctacctggttcgcaaaaaccaaaaaaggttggtgagtgattttcatcaaattgtctaaaatttcatctttatgcattattaaagttcctccgtttaacttatttagtttactttttatttaacgaactaaataataaaatcatttagttcgtttgtcaacgccaaaactaaataaattgcaataaaaaaatcaaaacccagccttaccggcagttagccgataaaactcaagttttgatttcgttaataatagttccttagctacggagcacctatttaattttcaaatcctggagttgttcctccacatcgtcaatcttagtgttgacttgtaataaagccgctgcggtatacgcgctttcgaccaaagccgtgtcgtacagtttaacttctttagtggtcatttccatggccatctctaaattcatcttcgcactgcctaaatcgtagaacgcgagcagcttgtctgccgcattgtcgtcaaacgcctgcatgatgcgttgcatctcggtacccacctcaccgttagcgagtccgccagcggtcgttaccggaacttcctgggcaacttgtttgattaagcgctgcacgccttgcgcaatttcggcgacgtgcgaaacaatcacaattccgtattccattatttcgcctccactgctagtaaagtcttcagtaagtaaccggtggaaacggctcccggatctaaatgacctaccgagcgttcaccaaggtaagacgcccggcccttcttggcaatcattggcttagtgctttcaaccgcccggtcaacatcctcggcagtgaacgtagccttttctgaaattggctcccagacgtccaccattgttttttcgcccaaaattgccttgccccgcttttgtactccagcggtggcggccaccaggagctcgtgtacgtcaccggtattagccttcgccatttcgatgaaggcggttccaaacaaaggaccagaggctccgccaaccttgctaatcaaactcatcgcaatcgttttaaaaattgctggcagatctggaaaatccttcccatccagggcttccattacagcattcattccgcgggccatgttatttccatggtcaccatccccgattggggtgtccaattcacttaaataagcgtgctgggcctgaatctcctgattaaatttttccatccacttttttacgtcttccactgttaacaaatcaatccgctcccttcaactaccatgcaatcgtgtgggttgcataatttaatttatcgacccagtcgtccttaattttaaggatggtcaatgaaactccggccatgtctaacgaagtcatgaggttcccgactttactgaaccggacgcgcaaaccttcttcggctaactgatctagcacatcattcataaaaacgtactgttccataagcggggttgcccccatgccatttaccaataccgctacggcgtcgccctttcgaaaccggaattccgaccttaacttttcaattagctcatttgccaatttcttagacggctgtaatttttcccgtcgataacctggctcaccgtggatccccactccgtattcaatttcgtcgtctgccaagacaaatccgggtttacccacttcgggaaccgtcgcaccacttaaagcaaccgccacggtcttcaaattaggcaatactgccgtagctaaatccgcaatttcatccaaactagccccttggtcggctgccgcgcccaaaattttatgcattaaaatagtgccggcaactccccgacgaccttgcgtataagtactattttctaccgcaacgtcgtcatcgaccacgatcgatttaacgggaatctcttccatttccgccatatcctgtgccatttcgaaattcatcacgtcgccagaatagtttttaatcactaaaaatacgccagcaccagaatttacttgcttaattgcttcaaaaatttggtcgggggtcggagaagtaaagacctcgccacaaaccgctgcactcagcattcccgcaccgacaaagccagcgtgcgcgggttcgtgcccacttccgccaccgctaacgatgccgactttgccagcaattttagccaaatccgtgcggtaaaccaccccggtttctggaatgcgttttaaataatctggataacttttcaccatcccctgaagcatttcttcgacaacttgcttcgggtcgttaataatttttttcatcatgccactccttttcgttttctttcctcacaattagattctagttgaaagcggatacaatcacaagtaatctccctcttcgatttacctgaatcgatcttttcctttataatgtgggagatgatgctaatttttaaaaggagttcgcaaaaatgattttagaacggaacaacatgtttaacattcgtcaaatcaacgatgatttagagcgggtcatcgggcccgagcacgttacggagctaaggaacttaatgcgttactaccggttatgccaatccgcagttaacgaagtgggaaccaagctggaaaacctcgacggcgaatacgagaatgagtacaaccataatcccattcatcacatggaacaacggatgaaatcggtcgactccctctttaataaaatgaaaaagaagcatctaccaaagacgattgccgcggtagaaaacaatatctttgacatcgggggcattcgggtaatcaccaactacatcagcgacgtctacaccatcaaggaaaacctgatttcccaagacgacgtcactttactcaaagtgaaggattacattcgggatcccaagccaagcggctaccgtagtctacacctggtcgtaaaggttccggtctttttatcaaccggtcccgtggaaaccccggtagaaattcaaatccgcaccgtcggaatggatatgtgggccagtttggaacacaagctgcgttataaaaccaacgttccttccgcaaaggtagcggattttgccgatcggttagttgacgacgccaatacgatttataaagtagaacaaaacttacaaaccatttaccgagaattatcagaacccggggttttcaaaaatgaagaataattaccccgtcacccgttattatggcgttccgttggagctagactcttccggcaattatcgttttaaatcaaccattaaaattcacgtttggcgaaacggtaaacatactcgcggtcattttcaaaaacctggccaattatttttgaccgaaaacaaccaattagtgatgattgtggcaacggaaaagatgaacttcagtcaacgtcattcgttagcacccattcagcggttcaccaaggagtcgattgcacccgacatgctggcaaccgcgcaacaagttttccatgaggaggattaattatgaaaaccttagtggtggtcgcccatcctaaactagcaagttctaccacccagcctttttttaaggcggccgttgaagacttcaccacggttacttggcatccgctccatgctgaatttgacgtaactcaagaacagcagcttttaaccgaacacgatcggattatcttccaatttccgctctactggtacggcgcaccgggccttttaaaaaattggcttgatcaagttctgaccgtgcgttttgccaccggaaatcgttatgcgttagctgataaagaactgggtttagtggttaccgcaggcgaagcagctgctgatttccaagccgggggagccgaacagtatacgatgtctgaactaatgcgtccgtttgaagcgctcgcccataagttacggatgcgttatctgccgatgatggccgttcatcaatttctctacttgactccagaagcccaacaacggctcctcgttcgttaccaacagtacgtaaacaatcctaattttgaacattttgccggtcaggtggcttggtttagcgaccagctgcggcaccaaatcactaaagcagaccccacctccgtcaccctaaaccaagtcttagagagcttagaaaatcggcaaagcgagctcgatgacctggcgtggaacctgtccatgttaaaaaaggaggaggattcctaatggaccaaaccgaaactacatggctattggaacaagctcgtcagcttgcccaacaagcaaccacttaccaacaaaaagccttctatgtagcattgggcgacctcatccaagaacaacaaaaacgggccgaccaactcgaaaacgagctcgacggccggatgtgggaacattaatccactaaaaaagacctaaccgaaatccccccataggtttcagttaggtcttttttaaaattttagtgcttgtcgtcacgctgctgacgatccttgttgttcttttcagcccattcttcacgggttagcacgtctttaacattaagtttgatttctgatacttccatgttggtgatttccttcactgcagaagtaatcttatcaatcatcttgtcaaagattgcttgggcgttcttcccgtattcaaggatggcatccatctttaaggaaacggaatggttttcgtcgtcaacgtcaacgttaactcccgtagttggatcgtcgcccttagaaattcgatcagttactttttcaaaaatattaccttcaagacttaaaacaccgtctactccgtttgcagttttgccagcaatttttgctaaaacttcgtcgtcaaacgttaatttagtttctggttttgccatcttgttttctgattttgcgattttattttccatgtgtcattgctcccttcgcgtgaatagttacttagcttctggacgaggcgctaagtctgaattaggtttacgattgttttgttctttccactctttcttgcttagtacgtcacttacgtggaaattcaattcaatgaccttcaaaccggtcaaacgttcaacttcctcgctaatcacgtcgcatacttgagtaaaaatttctcgaatatcgtaaccgtattccaccttagcattcatctctagcgatacctgtttttcgccaacttcagctttgattccttgagttggatccaccttgttacgaatcttgtcggtgatattgtcaaagaatccaccgtcaaatgagagaatcccatcgactttacgagaagctagtcccgcaattttttcgattaccccttcgtcaaatgacaaactagtttgcgcgattcttggtttatccatggttcaacgcctccttaaatttgcgacgattcttccaaacaaaccataagcttgataccaccattagacccattaatgatcttaatggtttattcttatctgttttcttggccattgacaaaacctccttagctttgcttgcgatccatgttcaaggctgacattacttctgaaatcaattgtgatagcaggcttctgccgtacttaccgagtaagaacccgattaaggcaagtaaaccaactaataccgcgctaccaaagccaatcgtgacccagataatgccgaaaatcattgcgatgattgctcctaaaacttcacttttcatttgccatcccgcctttctaaacgaccttcagtgacttcttcgagtgttgccgcggaatgatttggactttaacatcgctcttcattcctaggtggcgttgcacactctcttgtactgaacgttgaatatctcgtgcattgacccggtagttgtcattggacaaatcttccacgctgacttttgcttgcaagtgatccttgctgcgaacccgcaccttggtatcaatgttacctacgtgatggtcttcagcaactgccttattaataatttgttccatggatttctttggaacggtcaagttaccatgtccatcctgcaacttcaaatctttctcacttgtccgactcattaatgcaattccgagcattactaacgcaaacaaggcaaccagtatgctaaagacaattgcgataacttccattacctgtgcgttagacgtcctcaacgtttcaaagaaatcggttagatacggaatgtaaacttccgttgcgataaaccataaagttagaagcaacgtgattactgccatcaaactcaataaagatttactggttcgattcatgaaatcacccctaacccttcttgcgcatgccgaagattatcgagacaatcactactaaaattaccgcaccgaggattgacggaatcaatgccattccagctaaggaaggtccccatgaacctagtaagctttgtcctaaccaagctccgactaaaccagcaacaatgttaccaagccagcctgctggtaaatcacgacttgtaagtgccccggcgattgcaccgatgataccaccaataattaatgaccaaatccatcccaacataacaaacactcctctcgtaatctaaagattgaccaacgaacccgttgttcattggttcatcattaagatagcataggtggatacgcttcaacaaagaatatgcttatggaattaattacttattcgtaagggtggataataatataggaagacttccagagggtgccgtcatccaggaaagtcttgcagattagcgaaaatacggcattaagcgcgcggttaggcggttgatgccgtattttggttaaccggaaggcgttagattacttcacacatttcggtagtccgtttagcaaaacctgctacctaaacgtgggatagcgattgaggcgcaaaattggctaactacaagaaactggaatcaaaaaacaaaaaagcccctcaagaatttttagttcactcttgagaagcttttaaattgttattcattcttagtcgcgcctaaacgtgggacgcggatcagtttgctttacttaaggttcgccaaccaaccatcttaaaacacaaacggtgggaagcccgagtagtgttcttcgccgctgcgttccatccggtcgtggtcgattgctcgtgattggaaaattttaaaaatcccgtaatctttaagcggtagccaatcttcgttagacgcattgtccaaccgctctagacgatgcagatcgttaatcgtaatcttgtagttttgttccagcgggttgtgagcatggagcacccaaaactttttaattattggcataacgtgtcgttgttgcgcatattgacacatcaactcgtcgttttccacccggtacttagaagcaattttgcccatcgtgggtaagtaaacaaagctataatctagaaagggaaaatccgccattatttgcaaatgattttgttggcaatagtcgtaaatatcgtcgtttaacgacattggaaaataccccgtcttaaaaatcatcggggcaaccgtagcttttttcctaagtttttcaacctgttcaatgctaaagttagccacgcctagtgcgcctacacatcctttttcatacaactcttctaaagaatgccacagctcggtcattaactcgtcatcgtcaccaaataccgcttgatcaagcaataaagcgtcaaaataatcaaacttcattgtttggaaagcatcttcaatggcttcctcaaacgaaggcttgtcattaacttttttcgcaaaattaaccgtaatataaagatttttacgttttagtttaggttgtcggtacatttttaaagttaccgcaatatcgccatgcggttccttagtcatcggaaaatgggcataagggtcctcattgtcatcgtcagtgtccttaatctcttcataaaaatgacagtaacctgaccaaagcgcatcatgaaggcgactaacccctaacgccgtactaattatttgttttggtagtttagttccgttcactagctcagttaatgccataagtgacaccttcctctactttggatgtgatcattttataaacgcgtaagcggtttcttattaggaaaccagttaatctaaaaaggcgctatcgagcaccatcgctaaatttaaccgcttttctatccactttagcgttctttgacatcatactaacacttaatacactgaatagcaacatttagaatgaaccccgttaaatattttgcgtatttatattggtacactgcaatcatttttgaggtttagctaacccaactatcccagcagctaaaatcaatgccccaccaactaagttaagggatccgcccacgatttccaagatactgctagttttaaaaaatttgttttttttcatatcttaaattcctttctattacccaagcataacagttataaatcagctttactattgccaaagaattgttttaaactaagtatataacttttagaaattaggtgacaatcgtgataaaaatgattgcgacagatatggatcaaacctttcttaataaccaaaacacttataataaagaccggtttaaagaactgttcaatgaaatgcaacgacaaaaaattcattttgtagcggctagcggttctcaacatgaacgtttgcgggccttatttaccccgtacgccaaccaaatggattttatctcccaaaacggttcaattatttactctggcgaccaactcttagacgtggagcaacttcccgttccgctagttcaacaaaccattgacactatttttgaaaactttagcgctgatgaagtaatgattaacgtttgcgggttaaccagttcgtatattgatcaaaccaccccgcaagagatcgtcgactttttgcataaattttataaagaaattcgtctagtaaagaatttacgtaattttacgcaaaccggtattacagaccccattgtaaaaattgcagttagttttgcggacagcgcggatttgccaagtaaaattcaaaatcttcgtcaaaaactagatcctcaactgactagcctaagttcgggatttaataccgagttaatcggatttagccacgttgataaagcgagcgctctaaagcatctaatggctaattatcgggtggctcccgcagaattagttacgtttggtgataacgaaaatgaccttaagatgcttcaaatgaccccaaatggttacgcaatgaaaagcggatatcccattgtgaaagaagttacccaacaccagactcgttttgataatgaccatgatggtgttttagacgtgattgaaagcttgctataagttttcaagtagcgtgaaaacgatcgcttaagcggagtaaaactcctttgagcgcaccttatctttctgtataaaagccatcaaccaaattcctaaggttgcgaaccaacttgcaaaagtcagttggttccgtttaacccaaaatcgactattatgcccaatttagacataatagtcgattttttagttactgttcacaaactacctggcttgcgctccactcttgtattttcatctactattcttcaataaataagccgtccgtagccatgccagcagcttagcctgcatttgacgcttaatcttgcatgctttccactattttttggtaggccaccacggggtcagccgctttagtaattggcctgccgactaccaaagcagagcttcctgccttttgggcttccgcgggcgtcatcacccgctgctggtcgtccttctttgcgtcgggcatcctaattcctggagtgacgtacaaaaaatctgccgggaggaccggttttagttgggcaacttcgtgcggtgaacaaatcaccccgtctgcacccgcattttcagcaagttgggctaatttttggacctgttcattcattttcaagggcacattttgctcttcttgcaactggcgctccgaaattgatgtaagttccgttaccgctaatagcttaggagcgggaaccttcgctgcccgagcacctgccattaatccgcgcttagccgcctgaatcattggttttccacctaacgcatggaccgtagtgtattgaattcctaactttcctaattgaaacatggctttttccaccgtgttaggaatatcatgcaattttaaatctaaaaaaaaagcgtgtcccttttgacgcaggttccgtacaatttgagggccctgtccataaaacaactccattccaattttcacagttaacttaagatgtgacggaaattgttttaaaaagctttgtaattcttctacactttcaaaatccaacgcaatcattaccggtgttttcattatgatggctccttactgaaccgctccaccaaaggccaaagtagttaaggcaccgccgtaccttaaatgcacatctttattttgatgtaaacttgcttatcaacctcacagaattgatttaaagcgattcgttaattttttcttaatcctacgagcttccctccctaaagtcaagggtggtaaaatggttaaaacgttatttaaggagagcctatgcagaaaaatattgtccgtgaccaaaatttcttatcccaaaagtcagttcctgcaactcgagctgatttaccaacggctttggatcttgtggatactttagcagccaatgccgatcgggcagttggtttagccgccaacatgattggggttaaaaaacaaattattgccgtatccatcggcgtgatgaacattgccatgctgaatcctaaattaaccaaaaaaagccatccttatcaagctaaggaaggctgtctttcattaactggcgaacgttcaaccactcgttacaaagaaattgaggttcaataccaagatttgaacttcaaaaaacagacccagcattttagtggctggatcgctgaaatcatccaacatgaaatcgaccactgtgctggaattttaatttaaccttcggaaatgttattaaccggcttcattagaattaaatcgcgttgttccgattttcctaactgaaaacggtggtccccaacttgtttaaagccctgcatctggtaaaaatgctgggcttttttattattctcccaaactcctagccaaatttgagttttatgagctgcgtaagcaagttgttcagcttgcttaattaagcatgtgcctacacctctgcgttgaaaagacggtcgtacataaatccgttccacttccaaaacttgcgctcccatcggttcagattgtgcatccccaacgttgattttcaagtatccgacaatttcatcatcaatttttgcaaaaaagaattgcgattctggattcaataattcccgacgaagttggtctacattatacgctcgttgataatgctgctgtaaatctgcttccgcattgtagggcccaaaagttgcgccaaaggtttcaatgcttatcctgcgtaagttggctagatctcgttctcgaatcggttgaacttcaattgtcattcaatttcacctcaataatcgcgatggtttccgttcttaacgtaatgccagtcagcattaacgtttttttccacccgaagtaataaattacgaacctgtttaacttcttcttcagagagaccttgcaaggcggttgcgttagaatactcgttttcccgcttgataatgggataaacggaccgccccttttcggttgggtaaaggcgtttaattttttggttatctgccgtaaattggcgactaatcaatccttgatcttctaatttacgcaatgctcgcgctgccgtggtccggtcaactcgcagaagttcagctaattctccttgaataatgcctggattttcacaaactcgggcaaggtataaaaattgccccttggtgaggttaatttctttgaattccacgttagcaattgaatctaactcgcgtgcaattgaaccaataactcgcaaaatgtcttccattccgtattcctctccacgatgtgttatttacgtagtgctcgcacaatttgaccttcaattaacttcaaatcatccgcttcatttccgttatgagcaaagcgttgttgtaaaaagtaaaccgccagctgcccaataatcgttcgtacagttgccacggcatccagctcggggcgtacttcccctgtttgtcgcaaagcacggttcaagccctgtactagcgaatgttctggatcacttatcgtcgcaatgaagagctgtcgaacctcttcattagtgagcacctccattaatagaatcattgctgcatcaccatttttcaccataaaacggtaccgattttgcaccaaaaagtgaactaatttttcaagcgaattatattgcgctagttctgctagcaagtcatcccgataaactggaaaaaagttttctagtactggtttgatgattgcttttagtaaatcttgcttggttttaaaatacttaaaaatcgtggcctggctcacccccgccgcttctgctacctgcgccgttgaagttccatcgtagccatacctcgcaaataaatccagggcagctaatagggaatttcgctttcctttaggcatctcttgttcttgaagccattttttgtaattttcaaatactcttccgtccatgttcataccttccgataacgccgtagtccgacaatatttaacatagtcaatactacaagaaatcctagtaatataccaaggtctccccctaactttgttagaccggttccatacattatgatggaactaaccgcatctcccgcatacttaagggggattacgtaggaaattttttgcacccaatccgccatcgtatctagcgggatgatccctgcgaagaatacttgcggcaccacgacaatggggataaattgcatcatctggaactctgagttggcaaacgtagataatagtattccaaacgataacgcaactaacgccaacaacaagttaactatgatgatgttgaaaacgctccccactacttcgactcctaaaagttgaatagttactaaaacaattaccacggtctgtaaaacggcaattattccgtagctaatcatgtaaccgagaacaatttcactgcgtttaacgggcgtggctaacaaacggtccaaagttccactggtacgttcttttaaaagcgccattcccgaaactaagaacacaaagaaaaagacgaaaaagcccattaaaatcggcaagattttatcaaaaaagttagtatctgaatccccataaacgtatttactggtaacctttccttttgaagacgccttgttggccgggattgctttatttggggagctttggtgagtaacttgcgccaacttcgcttgaagctcagcgtttgtcttaatactccgttgtaaaacattctttaactcctgaacgttttcaagcatccttacgttgttgaaggccagtttaactgccgaagttttggtagcgtctgtattcgcgtacgtgatggtgtagtctacaccggaacgtttgataatcgcatctgctcgttgattatctaaagctttccgcgctgcagcttgactatcatattcctttactttaaaatgcttaacgttttctaagtcttgattcatctttttagtcactccgacagttgctacgttaaccttagtcgacgcattgttattaaagataaagcttaacagtaccaaaattaaaattggtgctaaaaacattagcgcaatcgttcgtttatccctaactaattcccttaaaactcgttgactaattgctaaaattcgtaacattatttagccccctccgctttcaaaaagacgtcttcaatagtgggtacttggtattgttcctcaagcttgctaggagcatccagagcaattacgtcgccgtctaaaataagcgccacctgatcgacttgttcagcttcatccattacgtgagttgtaattaaaatgctgcgtcccgcttccttaatttgctttaactcccgccaaatttgtcgacgtaaggctggatcgatgcccacggtgggttcgtctaaaattaaaagttgcggatctcctagaagcgcaattgctaaagaaagccggcgcatcattccgcctgagtaaccttggactggctggtcaatagcttcatttaagtccaccacatccacaacgtgggcaatttgatcagtcatcgcttgtcggttaatccccttcatctgagcgtaaaatttcaaattttcgcgccccgtcaagcttaaatacaaagcgtccgtttgcgccatgtaaccaatttgagctaatagctgccgattgggcatcgtttggccgaatatttttgcttctccttgatcggcattttccatccctaacgcgatcttgataatggttgatttaccggatccggaaggaccaatcaaacctagaatttctccaacattgatttctaagttgatatcttttaagacttgtaatttaccaaaactcttcgcaatcttggttaaagtaaccactttttccatcacgatttcctcccattttcatttggtgagtaattactcacttaccacagatttaatttaccaccattgcatataaaacgcaatcgtagttaacttcaattgaagttaaaatatacttaataactaaatactgcttgctaattcccttacgtaattagatataaataagcatggaggtgagttttaatggctaattattccactggtgaactagccaaaaaagtaggggtaagtatccgcacggttcagtattacgaccggcgacaattgctttcccctgctaaactttcagaagcgggtcggcgtgtttataccgaccatgaattagaacaattagaattaattactttcttgaaatcgctcggactttctttgaataatattaaggagcttttaaacagcccgaattttgacgaagtgctccaaactttgcttaaccaagaagaactacaattgaagcaaaagattaaacaacaagaggatactttaaaaacgattggtgaaattaaacactggttaactgatcaaattcccattacgcctaattcctttattggtattgaggaaagcattcgtcggcgacgtagtttaaccagaaaacgaagcgcgttgtttgttttcgggggcctaattgatattttagaaatattggcaatttggtatggcatttccagtagtaactggtgggcggtggtggccgctttttgccccattatagttgcggtggcaattgccgtatacgcatactaccgctcggttgagtacgtctgcccgcaatgcgaagcatacttcaaaccagcgtttggcgaatttttctgggcaaaacattcaccaaagacccgttggttagggtgccccaactgtgactatgagggttattgcgtggaaatatagcacattccgaatcccaggtaactctcgaggattaattaaaaaagaacgttaatcgcggattatgcgattagcgttcttttttggttggttaaccgatggaaactagaggttggagtttatttagctgtactaatctagtttttgcccaccagtaaaagcacgtctcaagatggatcagcattcttgaaacgtgcttttaaattgattgtccttaattaggtttaaaaattaatctacactactttattaatcaaaaatcttcttaactagcccaaatgctgaccaagcctttggccaacccgcataaaatgcgaggtgggtaactaattccaccatttcatctttagttacgccattggtcttagccattttcatatgtgcttccaattgtgggaacgctccttgagttagtaaactcgcgcaagtaatcatactccggtcccgcgccgaaagctgactttcacgcgaccatacttccccaaataatacgtcatcattgagttctgcaaatttaggtgctaagtcgcctaactgttcacgtccagccgtttgtttttttgccattctattcatcctcctcaactgctgcatattgttcttcactaacgggctctaaccattctggagttcctgcggtaattgccacgtgggtaaaccagctgtccttagttgcaccgtgccagtgcttaacgccctcgtgagtaaccaccacgtcaccggttgtaagatgctgcgccggttttccttcttcttggtaccaaccttcgccaccggtaactaataaaatttgaaagccattgtggtggatatgccagttattgcggcatcccggttcaaaagttacgttacccactcctacgtcaatctgagggtcggctaccaagttctgtagataactttggccgacaaaatattttgcgtaagcatcgttcttgggtccaataggaaaaattcccccagctttaattgcttcatttttcatttttaaaatcctttcaaattcaagtatttattcgttaaagtttctcttagtctcgtccgtcttaaatggcgaggataaagagcggtcactttgccccataaaaaaaccgtaactttatcaacatggataatgttacggctgtttttagtatacgtaaaatacttatttgttattatggtatgctccaaaggcatccttaaagtaattaataaattcattaactaccggggttaaatttcgttctcgtcgccaaactagtacacaattggtttttacttctggttgcagcggaataaatttgaccccttctggacgaatttgtgcggtcgccccttcaattccaaaagcttgtccaacttggcgtttaactaacgctaaaacgttgaaaattaaattgaaatttcccaccacttttagctgtgcgtagtcaatgccactccatttagtaactagctgccgaacctccggcctttgcgcgataaataaaggcatttctcgtagatcagctggctgaatagcattctttttagcccaggaagaatcttttgaaaccagtaatccccatctttcggtgcggggcagagtgatttccccatatttctcggtcgcgaccggttttaacagaaccgctacgtctaaaagccccttgtccaaccgcgtggtaatgtcgtcgctagtaccactgtagacggtaaacgtcacctgtgggtagtcttgcacaaacttttctaaaatcaaagctagcgtatccgaattatcagcttccacgcatccaatggcaattcgcccgctaaacagttgctttcgccgattttcaaactcgaggttggtttgttgcgttaattgtaaaatttcttccgcacgagttttcaaaaacaaaccagcatccgttaactgtaatttacgacgcccccgaataaataaggaggttcctagttcattttccagctcccttagctggcgactaagcgttggttgagtgatatgcagggcttttgcagccttagaaatggttccctcttcagcaatcgtccaaaaatatttaagcgtacgaatttccatattcttccccaatcatttctaaaattgaagttcaacacgtttattttaacttaatttaacttcaataagtaccgctatttcaaccatcatcaactgctaaaccaaggataagttgaagaagaacctaaaggtgctgaaccacatcattaagcactttacccgtccctctccgcttaacctaaaagcgaccatcacgcctaaatttggcataatggtcgcctttcagtgagtgtttataaaccacttaacttttgacatgatttcccttagttcgtgaaatttaacggtcaaaaacgacgctgtcacctgactttttttcgcggtcggcaccaataaaacgcagatctgtcccaatttgacccaagaaatccattaacgccgggtttagacctaattcgtctagtgcgtccggatccacctggtaacgaatggcgtcttcgtggccccgcgcaactttttcaacccattgcggttcgcgcagcgattcacggcccaaagcgacgaagtcaatcccttcgtccatcaccttttccgcgtcggctggcgtttctaccgaaccaactccgataattggtaaacgattatgcacttgttttttaatacgcaaaatggtgggccgtttttcactgtcgtcgtttaatgactttcgccatacgttccccatcgaaacgtggagataatccagcggttggtcagccaattcgtcaataaattgcagggtgtccgctagacgtattccaggctcttcaatctcttctggtgaaatacgatagcctagcataaagtggtctccagcatatttggcaaccgcacgatgtgcagcctgaacgactgccagcccaaagttcatccgtttttccaccgagccaccccagtgatccgtgcgccggttggaatgcggtgagaaaaattgttgaatcaaatacgtattggcaccgtgaatttcgaccccatcaaatcccgcttgaattgcccgtcgggtagcttcgccaaaggctttgatgatttgctcaatttcaatttctgacaattctcgaggagtttccattccttctcgcggagcggctaccgcacttgcgctaaccggttgggtgccccgtaaaactttgctatttgacatccgtccggcatgaaaaatctgcaaaattgtcttagtgccaccctttttcatggctgcggctaatttagccaatcccggaatgaagcggtcgtccgcaaccgaaagttcgccttcaaaccctttgccgttatccgtgacgttagcaaccgggctaataaacatgcctactcctccagcgcgcaatcctgcgtagaataggtcgtctcgggaaaccgatccgtcttctaaactagattggatggtcattggcggaatcaccactcgatttttgacttgtgccccacttttaaacgtgtatgactgtaaaaacttgtagctcaccattttttcgcttcctttctaaaaattccttacacttacgagtatactaggaaaacggttccaatcaaccgaaaacacttatcatactaaaactaattacttatacataaaaatccatcctcctcctggcattacaaaaaagctctccaaggattttcatccttgaggagctttatctaaattggttacactttagtttaattggattaaatcattaccgtaatggttgctgctactagaattagtactaaaccagcaatcgtaacggccatttcttttggcgtctttttttgacctaagaaccaaattccggttaaggttgccaaaactactgacgtttgtgacaagatgaaaccagttgccaaaccattcatgtttggttgtgccgaaatcaagtaagtcaacgctgcaaaggcaaagaaaaagcccgaaatgatttgtttataagaaactgcttcagttaaggccgatttttcgcccttcatcgaaaggaagacggcgtagacaacgcctacaattaccattccaatcgcctgtggcaagaaagcgtgcatcccgtcaactggagttgcttgaggagccgccgaatatacccagtatccgatttccccgactgctaaccaacccactgcttgggtgattaacttggaattttcctttgttttgtgttccgaccaaaccgtcaaggaagcaccaaaaatgatcatgattaacgcgattccaccaacgattttagccgtgattcctggccagtttcctaaggcgatcacgccccataacgaagctcccaagagttgaaacgccgtagtaattggcattgcacgtgatgaaccaatcattgcaaaactcttaaatgtaataatttcagcacttgcccaaccaattccagaagcgatggttaaaactaagttccaaccggtaggtaagcttaggccgttcaccattgcgactaccaacgcaaaaatgaaagtaccaaaagcggtcccgacaatctggtcaaccggacgaccgccgattttagatgctagggtaggaaacagtccccacccaatcaacggtccaagaccgattaaaattgctgttgcattcatactttttcccccttaaataaagaggctgggaacattgcttccgcagcctcggttaattcctatggcgttgaccaaacatattaataatacgccttcaataggccaatggaaatcttttaccgtagttaatattgactatctaactgctcaatccccttaagggtaattaaaatactacgccgctttccagaatgatatttgaataaggcgtcatttctcccgtccgaatgaacgcgcgacagttgtttaagtcttgcttcatttctgagtgtggaatgaaagtaaccggcacgttaggcattatttcttgaatgctttccagcatcttaggattttcggtcttgatttcttccgctaagtaaattcgttgtacttctaattcttctaaaacgttcaaaagtacttgagtaaagcttggaattccattatcaactgctaagtcgattttttcagttcctgctggtactggcatacccgcgtcaccaatgcttaacttatcaaagtgacccatttgggcaattacccgtgaaatatctgaattgattacttttgtttttttcattttttccgcaccccttcgttaatttaattctttcttgtatggaatcgatggttgcgcaccaaagcgttgcaccgtcaatgatgacgccttattaccataaaggattgcgtctttaagattgctaaagtctggattcaaaaccgtgctcatagcaccaatgaaagtatctccagctgaagtagtgtcgacggccttcaccttaaatgcgggaacgatcccggtttcaccattaacactgtaaaaagttcccttactaccaatggtgattaacacagccttaattccttggtcatgcaaagctttagcagccttcaccatgctagcttcgtcagtgacttcaattccagtgaggatttcagtttccgtttcgttaggaataatcatatccgttacggctagcaaatcatccggaaccttttcaattgcgggagccggattcaaaattgtttttacacccgcttcgtgagcgattttaaaagccttagtagttgcttccaacccagtttcaaattgagcaataacgaaatcactatttttaatcacgtctgctttagatgctacgtaatccggagtaaaggccatgtttgcaccggcatgaagcataatttcattttcaccagcgtcgtcaaccacaatgtatgcttgaccagttgcctgattgtccaaagtagtaactccactaaggtcaatatcttcatgttctagtaaatctaacattgcccggccagcatcatcgtttcctactgcgccaataaaattggtttttgcttcggaacgcttagctgccaccgcttggtttgcgcccttgccgccaccagcggagaagatttcttttgtatgcatcgtttctccaggtttgggcatttgcttaacccgaattgtgcgatctaaattaatacttccaataatcgttaccgtactcaaattgttttcctcctgagttataaaaattgccatttattttaggtaaaacgttttactaaacaaaaaaataaaaatgccttccgcatgaaaacgttttaaagacataatagaaatatagcacaacacttaaattaattcaaacgggcagtggaaaatcgttttactaattgaaccggcaacaactcttcttcccattgtttgtttggcttttcgattcggtcaattaacatttttgccgtagtttgccctaattcaaaaattggctgcgcaatcgtagttaactgggggaccacgtattcgcacatatcaatgttatcgtacccaattacgctgtaatcttcaggaattcggcatccctgatcagccagcccgaggtataaccctaaggcaatttgatcgtttaccgcaaaaatcgccgtcgcgggcgaattaattaccgcttgggccgctttacgtccgctctttttggatagctcggcgtctacgcgaacaatctcgtcttccccaaataccgtttggaagccgcgaagtcggttttgaatattttccgtggcgttttcaggcattacaacggcgacttgccggtggcctaaatcccataaatgctgggccgcttgttgtccaccagaaaaatcgtcggtaagaaccgcgtcgctgattccctccgactttttttggtctaaaacgataaaaggaaatttttcgccgcgcaggattttttgaattgcctcgttagaaattgacgagctagcaatgataaaaccatcgactccccggtgggtaagttccgttaaataacggtcttccttaccttgatccatatccgcgttgcaaagcatcgtcatgaaatcatattggtataatacgttttcaatcccgcgaaccaagctgttgaaaaagggattagtaatgtccggaaccaacaccccgatcatcttacttttcttcataatcatccgctgcgcaaagtaatctggttcgtaacccagtttttctttagcgcgttgaatacgtttgatcgttcttggagagaaacgagagccgttcccatttaaagcttgggaaaccgtggtaacggaaaccccggcagctttggcaacgtctttgatcgtaactttctttttattcattatgtcaaccacacctaaattgataaattgttttaaggaatagtgtacactaaaaaaagcaagcgtgtgcaaatctctttggaagattttacggtctcatagaataaataattaattattcacctgaaaaattaattaatccgtgggctttaccaaactggcaaaaagcatttttaatgcgcgattccttagttacggaacctaaaaaaacaggctgccagaaatccctgacagcccgcttataaaactaatttttaacttcaattgaagttcatttttaacttcatttaactattcctaaagtttgtaagatcagataaatgttcaataaaatcaatattattgtagcaatccaagcacaccacttcacccactgacggttagcaaactcacccatcagttttttactactggtatacattaccaacggaattaccgcgaatggcaacgcaacactgaggaacacttgggagaaagtcaatagattttcaatcttggcttcgtcaccatgatagtaaatcgcaaaaatcaaaaccggtgccaccgagagcaaacgggttaccaaccgttgtacccacaacggaaccctcaggcgaatgaaaccttccatgataatttgtccggaaagggttccggtaatcgttgaactttgtccagacgcgagcaacgctaccgcaaatagcatactcaacattggactagcaattgctccaacaatttgattgtcactaagcgcattgaacaagtccacaaatcgacctaacgagctatcggttccgtaaaacaaagccgcccctaaaatcaagagcaaactgttgacgataaacgccaaaaatagttgcatattagagtcaatcgtggaaaaacgaattgcttgagccacgtttttacgatcccggcggttaatttcacgcgtttgcgaaatcgaagatcctaggtaaaggtcgtgaggcattacggttgcccccacgatccccaatgataaatatagcattgaattgttctgcaaaattactggtgcaggcacgtaacctttaatgattcccgaaatactaggatccgaaaggaaaacttcgtaagcaaaaacaattaagatcaccattaccaatgtcgctacaatcgcctcaattttccggaagcctaagcgcattagcaatagcaaaatcaatacatccgctgcggtaatcaagattccgataattagtggaatgtggaataatagctcaagcgcaatccctgaaccaataatttccgcaatgtcggtcgccataattgctaattcagcaaccacccacagcataaatccgactcgtttgctagtacgctcccgagttaactgcgctaaatcctttccggttacaattcctaaccttgccgacattgcttgtaaaagcatggcaattaagctagaaatcaaaaccaccgacagcaacgtatatttaaattgagcaccacccgcgattgacgtaatccaattccctggatccatgtaaccaaccgcgattaagattcccggcccggtataggccattaacgttttgaaaaagccggcattctttggcaccttaatactaccgttaatctcatctaagctcttgttatctacttcatcgagtttttctgacattgtagcccctcttttctattggtttagaaattcggtaacttgaaacaaactctccacgctaaaaattgacccattttaatatcagcgaattaaaaatggatcaatttttgatatcttcttttttaaaacggagcgctcttttcaaaaaccataactactataccataaaccgttatttaaatgaccacaattgcgcttaatttttttcacaacgttccgtggccttcaattatcgcttacgggttaacacagcgattgcaaacataaggttcactacgacaatgattccccagttaaattgaaactgatgagggaaaaagtccgccacccaccagctcatccccgtggtaatcagcgcaaacaaaagtatttcgcggattttacgacgccaatccatcaaattcacccaacttatttttaatcaatttagtcatttaaggacccattgtcacatttaagcgttaagccaattatagcgcctatggtttaacttgcctaactttaactagtccctcgggcgtcacccgaaataatccagtacgataatcttggtgataggtcttttgcaacattaccgtaaacgtacggtgccattctggaagcgcgatgtattggtaactttgaactaattttttaaagtcggttggcgacatcatgaaatcttcacgagcgaccacgttgtccgaaaaaaaataatattttccaacgtatcccgcgtagtaacttgctacgtcatcttgatgcgggtcgactaacaaaactttttggtggttgtacttggtggtctgcttggcgatttggggcagctggaccggcagcgcttcttgactatgcgcgttattatactccacaccatcaatttctgaaatcatcaaaattgttgaaaagatcatcagtgcaagcgtcgtgaattggtaaatgtttttggtaatcagagaactaaacgaacgaacgcctcgtttttgaatttcttgtacaaacattgcccgatccatcgctatcgcaattgctaaagcagctaggaagaggtttaaaaccaccatgctagataagtaacgttctagtacatcaagttgaatggcctccttgtacggcatggaaacgaggtacatagccaatacactcacgtaataaaccacaaaactaaggtcgatggctaatagtacttttaaaagcggagtgcgcttatgtaaaacaagtccaatcaccacccaggccacgattaaaccaatgttaattaataaaacgcccctcgtagacagggaatttaacgttaaaatttgatgaatgaattggtggctaatccgacccattacggcagagctttcgtggtttagctgactttgatacgcttgggcgctgatctgatgtttagtaactgcgtgaaacgtgttgtgcacgtgttggttccaccaaaaaaagggcaaataactgagtcccatagtaagtgcagttcgccatgacgcaaaccggatccgtaaccaacgcttatcaacgccatagttagtggttaacgagtacaccagataacatccaatcatcaccacgtacatcgtccccgaatttttaattagtaacagttctgcgctaaaaatcccagcagttacgcattgtaaccacggatggcgacgatacgagtaaattcccgcgaaagccgcggccgccaacactggcaaaacaaagtctaccagaaggttattcatccgaattgcgatgttaaaaacgttactgatggcaatgatgaaacacaagaagaatgctgtcatagtacgactacgatcccgtaatgcagcaaaaagggcgtatagtcccgcccaaatcaacaggaattgtcccactaacatggcgccttcactaaaaccaacccagctaacaaattccgtaatccataaagccgcggccggcggataggacgtgaaagaaattaaagtttcgcctccggctggtaagtacccttgaaacaataaaaacttaaccattacggcccagtgagaataattatcgtagtgaattaagggactgagatataaagtgtggcccatcataatgcccaaaaacagcatccaaaagtcaaaataatggattccttcaaaggggagcttcccccgattaaaactgatcaagccgacccgcacaaccagtccgatacaacccacaatcacgacggccttaagcccgaactccaataaatttagcattgccagaaagtacaacgccaaggtttggacgaccattgccgtaatccacgacatgtacttgtttacgccagccattcggattaaccccgtatatcctagctgtgccattgcaaaaataatcaaaccaaaaaatgacatttttccattacctacatttctaagctaacttttatgaacgccgcataaagcgcgtcgcggaccgttctaattctttcaatcgcaaaattacgttcaaatgaagttggtcaaacggtgttagccaattatcttgttctttagagaggaacttgttttccccgtcatacgttagttctaagtagtaatcctgatccttacggtcttcaatattaattgtcactccgtaccatttcggttcagtatcgactactcggacaactttgctcttaaaatgaattggataatttttgtaatagatgattcccgtcgtttccgttcccatttctagttgattttggtcgtcatccaattcaaacgaaaaaccgccatccgaaacgtctcgggttttaaaatccgcccactttccatttgccaactgcatgcgaccctttgcgtggcgaataaaccgttcgctacgacgatgaatgtctcgtttcatcgagataaacaggcagaaactaaggttaatgaagtgcattaccaaccaaaatgtaattacacttcccacaataatttctgacccccactttccccagttaaatttaataatcgcaattaacgttagcgaccataaaatcaaatacgggataatgtacaatttgtctcgccaagaaaattgtacttttttatccgttactttaaattttttggcgtgaataccaattgattccagtaacacgggtaaaaataagtatggggcaaaaaaggtttcttgtatttctccccaccgttcgttacgaatattactggaggcatctcccagtacaaagtgcagcaagaaatatcccggtgcccagacaatcattagcacccagaaattagcattaacgacctgcactttaaaaagagcgtacaaaatcggagccgcaatataaattaatcggcgcaaaaaggactaccagtaaagccacgtattaatcaaaataattcgattaattaagttgattttgggattcaaaaagatgtggaggttacgacaactttgaattactccccgagcccagcgcgtccgttgcttgataacactcttcatatctaccggagtaattccgcttgaaacgggttctaccgttgccaaactcttatagccctcactgttaattttggttcctaattcgaaatccttcgtgattgtatccgtagggaaaccgctcactttatcgaccgcttcccgtaagaacactgcgttagacccggtaaataaagcatgcccattggcaccgtttaaaacgttaacgtcacgcgagaaaaagtcttgttcgttaactaccgcatcttgcaaaaagaggttgaactggaaaatatctgcgttataaaagctttgtggcgtttgtacaaatcctaacggcacggtatgatcgggatcttcttgcaactcagcaaaattttccgtaaaaaacgggacgctctccattaaaaagttggagaaaggtaccatatccgcgtcaaagatggcaaacaacggtgcatgaagctgttccaatgcattgttaatgtttcccgccttagcatgcttattttcttccatcgtaacgtaattagcatggtactccttggctaactggcgaacttccggacgattcccatcgtctgcgatcaccacgttaaccaacttagggtcgggatatttcatgaatttggccgcattcacggttttacgcaataaagccacctcttcgttatgggtgacgataatcacgtcaatcgccgggaggggttggcgatcatcaaaatccgggattttaaaatcgaccggtttcttttgccgaattaaccggaaagcaatcaatacgtaagccgtaaagttagagacaatctcactaccaaccaacatcaacgcaaaaatcagtgtaaagaggtgggcgtgccacggaatcgtaaaaaacacccgccataacaggtacaaaacggacaaaacaattgctaaaatataactaatttttttgatttttggcattagtcagcccctcgcttttccttaaagatcaaatcacgttggatttgatagctgataataaataacgtaaagtccaccacaattttagcgattaacggtgcgacactgccctggctgtgtggtaaccatcccgtaactaaatcagttaggtatccggaagcaaacatttggataataaacaacaccccgtatttaataacggtctgacgtccctgtttgccaaataccacccgatggttcagcgtgtaattaaccatcgcagatagcaagcgtgaaacaattgtggccacgataattcgttctccaagtaattcttttcccatcaaaacaatcattaattcaaacaatcctacatcaactagaaaagaaatcaacccgctcatcgcgaatttcaaaaaacgtgcgtatattgcgaccgaatcacgaaccacccgaaagtgtgatgacttattgccatctaaataaattgtggggattggttgttcggtaatcttaacctggaacttccgtgctcgaagcaacatgtcaaactcaaattcaaaacgttctcccggaaaaataagtaattgcctcacgtagcttcgaggaatcacccgcagaccagtttgcgtatctgaaatattttgccgagtgagcatgcgcactaatttacgcgttaatacgttaccaaactggctccgccatgggatttgatttgtaaattgacgtgcaccgataattaagtcttgcggatgcttttcaaactgatgaatacaagccgctaatgcatccaccggatgttgtccatccgcatccatggtagcaatcccctgaatttgtgggaaattttctaaaatgtacttaaaacccgttttcaacgcggctccctttccccgattaacctcgtgatgcagtatatgaatacgttcatcttccatatctgcaagacgttggaaaatcggctgcgcctgctggtcgctaccatcgtcaacgaccacgagtgcctgtacgggaaccgaactttctaacagctcctgaattaaaccgagtaatttttcatcaggatttaatgccggaatcaagacgccgtaagctttcattggtttcctccgatatctattttttaattattaaaaaactatgtgttttttgtgacttggtgtattaaaaaacatatagttacgattatttttttaaggcttaaaaataacatagtttttcagttacactagcgcttatcatacttcaaaacgggcaccaattcaatttaaactagtaattaaacaataaaacattaaatgaactcaattttacatttagccttgaacgagtagaattaaaatgtgaggttaactcaaaaaaatacatactatttaaaccattttactaaagaaaactattaaactgatttgtaattatttacttaaagaaagtgggtaaacgtaatgaacttatggggagcagtcttttttatcctgagccaaattggttttgcaggcatcctacgcatggcagggatcgataaatatttgtcctggatcacttccatagttatccagaccctccttctctatattttggcaatggttggcctgctttccttcgggatccgctccgtcgtcttcgttggatgcgtttttttcttacttcgtctcatctttatcgtccttcaaattggtaaattacctttcgaaggaattcattattttgacgtctggatggtggtaatcgggcttaccgtgctccacacgctaagtcaaagtatccttattcactatgacaaccactcccactgggccatcattgttaaatatctgcttacccaagggcatcttccaattgcgggcgattcaatcatttcttttacgtcttatccgcctgcgaccgcgctttggattaccgaatttgttagctgggttggttttaacgacgggaccatgctggttgcccaatttttattaatctgggctagtttatacgctctttttgccgttctacgcgaccgtacccgttcaatgaacggtttctttctttgtttcattattgcgataataaatgtttttaacatcgcaattcgtatgaataatttactggttgattttgtccttcccgtagttaccgcagctggatttgccggaatttatgccgaacgaaaacatcccctttggcaatgcagcatcaccgcgctttttagtgccgaattactattagttaaaaattctggaaccatgtacgtggcaatgctggttgcttatttgctgtattcacttgcaaccaatcgcgaaggcacgcgctggcaacgatggttttgcagcttggctttgagtgcgtttaccgcagtaattggctttctaccctttttttggtggaatcaacacgttcacaacaccttcacgacaatttctaagcaccaaattagtgcccaagcgtaccagcaacagttgcatcacgaaggcaatgccgttgttatcaagattggccatcgctttctcgaccaaatattaaattggcatgccctatcgacccggggggttttgctaattaacgctggtttattaattggttggattgtaattactttccttatgcaccataaaaatccattgctaaaaacactatttgctatcgacgttagttttctaatttactacggtagcgtatttgccatgtacctcgtttccatgccctacgcagaagcgattcaacttgatgggttagagcgctacctatcaagcatggtgattttaaatcttctgctaggcgctatggtattagctgtggttatggaccaggtgatgttcgaacaaagaattggccggcggggggttcgttcctttaaaaacgtgtttaccaaaaatctttatcagcttacggcgttggtactaatgattttctcgaccattttaatgttttcagaaataaacggaatcgaatataacaacaccttgggtaaagaacagctcccagttcaactaaaacaaattgcccaaccttcgatgacttacaatcaccgcaaaattttactggtagacccgcacactaacgacgttaataactactatgccggttacgttggccgttactacttcttttccgataaagtcgttggtcaagagaacttcatgatggatccggctacttttaaaaagaccgttgccacttaccaatacgtagctttaccagaatggcaccgcacatttacggtaatgttgcaaaagacctatcatcaaagttataaaaccgggctttaccgcgttacttcccgtggattgcgtcgagtgcagaaaataactccggttaaaaattaaccaaacgatttcattttccctaaattacttgtatcatagaaatgtaagcgcattatcagaccattgaggaggattcacccatgcttttaaccattgttcgtcacagtactagtcaagataacggtcgcggattagtttccggagcccgttccgacgtcggtttgtccccggccggaatcgaatatgctaaggaagttagtcaaaattacgattggcaccagtttgaccacgttttttgcagtcccatgctgcgtgctaaacaaaccgcgaagattcttttaggtgatgacgctgcgctcacctatgatccccggattattgaaatggactttggcgattgggacggggtctccgaaaaattaatttacgacaagcatcccgaagtttttgaccgtcttggtatgttcaacgccaagtacgctgactacgcgccccattccgaaagttatgccgcactggttgcgcgggtaagcgggtttgtcgaagaccttaaacagcagtttgctgatcaatccgtactattaatttgtcatgggatgacaactcgggcaatttttgcagccatcttcaacgttgacgtagctgaatttggcatcgttcaaaacgtaaccctaaatcaaattcaccttgatgaaaaggaccactttaagccccggttaaattgctataataatcgggtttagttcggctaacccgtaacttcgaccattcaattttctgtaaacaaaaagatgacggtgcagaattttctaattcgatccgtcatcttttttattactcgtgataaaaactactatcccaatacttctttaatcgcgtcaaccattggggttaaaggctttccgaggtatttttcaaaatcgtcaggttgcactgctaaagcaccgcttttgacaatttgttgaaaggaaaccaacagttcagccacgttttgtggtactcccgcattttcgacgaggttttttgcagcggtagcttcatccgcgctgatcacttccaggtctttaccagttgctccccgtaaggctgcacccaaatcttcgtaagtgcgaagttgtccacctaattctaggatttcagggaaatcaaattttccggaaaccgctcgtgccgcaacttcggcgtattcgcgacgaagtgcccagccagcttggccgttgccgcccgcatagatgaacttgccacctttagcgcccgctgctaaaaaggccgcttcgttttccaaataccaattattccgtaagaaagtatgggcaattccgctttcttcaataagctgctcggtaaaccgatggtcagcggcgagcggactagttgattccgttgccttgccaaaactggtgtacgcaatgtagcccactcccgctgccttggctgcctcgacgacatcccgatgttgcgcttggcggtcaccatccgttgtactcgagacaaagagtaaccgatcgattccctcaaaagctttttgcaagtttgccgaatcagtataatcaccaatccgtactttaatccccgcttcctttagcttagcacccttctcttcagtccgagcaaggccgtatagattatcttctggaactaaatcctgtaaaacttttaaagcatatcccccaaagttacctgtagcgcccgttactaaaatattcataatcaaatcctcactttcgttattaactgattagctgtacatttataaatcacacgtttataataagggtagtaattctgattgtcaagtgataaattctagaagggagttgatgataatgaaatattccatgcgttttagcgataccatccacgtgttggcttacattgccattctgcacgatacggccccgttgactagtcaggccatcgcagccagtgtggaaaccaacccgtctaacatccgccgaattatggcgtcacttaaaaaagctggattgattaaaaccactgtgggtaagccccagccagcgctaacccgggcaccagaacaaatttctttattagacattttcaacagtcttgatgaggctgacacgaatttaattcaagttgaccccaaaacgaacccggactgcgtggtaggcggcaacatccaagatgctttaaacgctcaatacgcccattttcaaaaagttttccaagacgaaatggctaaaaccactttggccgacgtcattcaggatattgcaactaacgaagtcaaaaaacggcccgaaaatcaggaattggtagctaattttttgaattcataattttactaaaaaagacgtaggtgtacgttcgaattgaagaatttggcagtttcttcaattaacgtaaatcctacgtcttttttattttttgaacttgctagttaaagttattttttcaaaaccatacgttccgcatccacgcctaactcggttttgatccgttgctgtaattcttcagcagcttgttgtgcacgttgcgcttggtcagcgttaaccgcttcgataaccaataccgcatcggtagtttcatcagttagcatggtgcgttgagcctcacgccaattaaagcagcggcaaatagccccagtttggtcgtaataaatgacttcccctggcaacgctggctcatcttcttctactccaaggggccggaaactttcgccgcccttagcaactccgatatgcatcgtaccatccattttttgtaaatcttcgctgccacacggcacgccaaattcgagcgaaatactattataaatatcgactaacgggttaattggactaagcgattttccttgggaaactcgtttgagcaacgcttcaattgacgaacgggcgccttttttcttcttaaatttggtaaacgcatcccgccattcactaatcaccgggttattccgaaaaacatcatcagtaataaatttctgggcttctttaacggcattgtctaacattgcttgatagtgttccgtttgcatagccgctagatggttatcaatgccatgcgctaccaataattgaaactgcgcttcgggaaataattcccagatttgatcatcaacgattaatggttgcatattaaacttcctcctcttaatacttacagattaattcacagccattatctaacaaaataggtgcaaatgcaacaaaactaacaaaaaagactgagagaaaattccctcagtcttttcgtcaactcaactaaataaaattagttaagcttagttttgctttgaacttcaagcttgtcgttgaagtcgtaaacaactggttcgccagttgccatttcaagattcatgatgtcttcatcagaaatgttttcgatgtacttgctcaaagcacgaagtgagttaccatgagcagcaatgataacgttcttgttgtcaagcaacttaggagcaatttcatcttcccagaaaggaataacccgttcaagagttaccttaaggttttcaccaccagggatgatgcgtgggtctaggtttgcgtaacgacggtcgttagcagctgaaccttcatcgctagcatctaacaatggaggaagtacgtcgtatgaacggcgccaaatatgaacttgttcgtcgccccatttttcagcagccttagccttgttttggccttgcaatgcaccgtagtgacgttcgttcaaacgccatgtcttggtttctggaatccaaagttggtcagattcttccaaagcatagtgcaaagtcttgatggcacgagttaatactgaagtgtaagcttggtcaaattcaagaccagcttccttaattaacttaccagcattttttgcttgtttaacaccttcatcactaagatcaacgtcaacccaaccagtaaattggtttgataagttccattcactttgaccatgacgaatcaaaactaattttgccatatcgtttgaatacctctttcttcaaataaatttctaacgttctaattttacaatttttaaccgctaagcacaaacctaaaataaagaagttttcttaatcgagatcaatttggttaggaaagtgtgctagccgggtgccggctttgcctaactcttcttcgatccgcaaaagctggttatatttttccacccgttctgagcgtgccggtgctcctgcctttaattgcgctgcgtttgtggccacggtaaagtccgcaacaaatgtatccgccgtttcaccagaacggtgcgacatcatcgtggtatagccatttttgcgggctacccggatggcttcgagcgtttccgtaaccgtcccaatttggtttaacttgaataaaattgaatttgccatcccttttttgatagcttcccgaatcaagcgcggattcgtgcagaccgggtcgtcagccacaatttggactctttgcccatattcactagtaaatttactaaagttgttccaatcttcttccccgtaaggatcctcgatggaaatgatttctggaaactcgtttagcagcttgccgtagtattctcctagttcttgcggtgtgtacgtccggccttcaaaatcgtaattcttggtctctcgattatagaaataggaggccgccgcatcaaaagcaatcgccacttctttcccaggaacgtagcctgctttaacaatcgctttgtgtaacatttttaaagcgtcttctgaggaaggtaaatccggcgcaaagccgccttcatccccccagcccagtggaataacccgcatcggcaataatttttttcaatacgtgataggtattgacaattttttcaaatccctcccggaaactagtccgttccaccggagtaatcatgaattcctgaatatcaatttggttattagcgtgctcgcccccgttaattacgttatgaaaagtttgcggaagttctaaatcagttccccctaagtaccggtagagagggatgtggagcgcattggccgccgctcttgccgtagccatggaaacgcctaaaattgcgttggcgcctaatttacgcttattgttagtgccgtctaaatcaatcattatttcgtcaacgttagcctggttgaagggatcaaccccctttaaagccaccgcaatattgttatttacgttgccaatcgcctttagcacccctttgccagataaccgtttaccaccgtctcgtaactcgacagcttccttttctccagtagaagcccccgaaggtaccgcagcccgacccatgatcccgttagacagcgttacgtcaacttctaccgtcggatttccccgtgaatcgaagatctcgcgtgccttaacattttcaataactagtgacattactaaattccccctcttaaacaaaaaagacgcctattatccccaggaatttcctagaaataatagacgtcatcaaattaatgtttaattatttttacggcgaacgtcatcgcctatttagttacagccatattgtagttccacttagtaatttttacaacccgctttttgaaaatttgcgcaattttataaatacaactgcgccaaaaattatttttgtgaggacgcggaaggaccttcgaccatggcgttttcagcttctttttcagtctgagaaggtttactgctgccagagctgctcgtttccgatgaagaattagttgaatcatcagaatctggcttatcgcttgattccttgttcgagggcttatccttagaatcatctttagaagaactgtccttaggtttctttttaggcgccgccggtttggtggtagtcggcccttcgtagcgtggccttacctttggcttaagggatttatttgccgccccttggttattgtccggcgtcgtatcactattgaaagctccttggtcagcaacgatcccagcattattaaaccgttgcagcgttagtgcctgatcatggagggtttcataatatcccttattaaattcttcgttgctaagcagcaagtctaactgcgcatttgacgcataaaaatcccacgccgcgttcaattttttagctctctttagttgtttactgaattttttaaaattagccctaatttttttaattaatttgatccgtgcttgactacgctctttcaacgttctagagccgtctgaaattttcagcacgttttggtaatctaaccgcgcgctggtaaattcattacttttaaattcagattctgcgcgggtaaattgccgagtttggtcgaggaggttggttgcttcccgatcatttttcttctttgtgagggcccgtgaaaaataattcttggcagccgcgtaatttttttgggcaatcgccgtttgtccgttggtgatgttgcgttgatattgcagttcattttcgtgataatgagcaactgagtacccaccaaccactccggcgaccaaaaaaatcagaaccgcccaaatccactttttcatcggtattcctccccattcaggtgtctgcttaattataccacgtaaggcttcattacccatattagggaattcgttttcattagcttctcatttgaaatatttacccaaacacgttataacagttgtataactatttttggaaaggacctgaatcatgcttgagaaacaattttataaaacgtttttaaaacgttcattcaatatcccaattaaagttaattattgggatggaagttccgcagtttacgggacgggagaaccccaagcaaccattacttttaaaaaggccattccgattaaaagcattactaagaatgcttcaatcgcccttggggaggcgtacatggatggtacgattaccgtcgatggtaatttacaaaagttaattacttctgcttacgaaaatgcggacagctttttccacaacaagaagttcatccactttcttcctaaacaaggccacggcgaaaaggaaagtaaagaagatgtgcaaaaccactacgatattggaaacgacttctataaattatggttagatccaacaatgacttattcttgtgcttactttgaaagcgaccaagatagcttggaaacggcacaaatgaataaggttcgccacattattcggaaactaaacccacaacctggaaaaactcttttagacatcggttgtggttggggaaccctaatgcttactgccgctaaagaatttaacttaaaggtagtcggtgtaacccttagccaagaacaatacgacttggttaaccaacgtatccaagaagaaggacttagcggggttgcagaagttcggcttcaagattaccgggaacttggtgacgagaagtttgactacattaccagtgtgggaatgtttgaacacgttggaaaggaaaacttggggatctactttgataacgtagctaagtacttaaaggatgatggggtcgcgttgatccacggaatcacccggcaacaaggcggggctaacaacggctggctaaacaagtggattttcccaggtggatacgtacctggtttggtagaaaatatcgaacacattgttaacagcggtctccaaattgacgatatggaaccattgcgtcggcattaccaacggactactgaaatttgggacgctaacttcaacaaacatcgtgacgaagtacgcgaaatgttcgacgaaaaattcgttcggatgtgggatttgtacttacaagcatgcgcggcgtcgtttgaatctggcaacattgacgtaatccaatacttgctaactaagggagcaagtggtcgggtccttccaatgacgcgagattatatgtatgaaaaatagagcattctaaaacctgggtagctcttgaggataactgaattaggggaccggccgcgaatttagcggttggtcccctaatttggttaaccggagagagctgggttttagaacgcgtttcagctacgcggcaaaaaacgaaaattcataaaaattaatcgcggttttggcgattagttttatgattttgctaaccggagaagataggtggctggagttcgtttcgaccatgctgcaaaaaggcgaaaaaattaagggattaatcgcggtttatgcgattgatcccttaatttagttaaccggaggaagttgaggttcggagttcgtttcagctacgcggcagtcttaaaagtaacatcgacttttcggcaaaaatccaataaaattatcatcaagttaatcatttgaaagtaggacgttaacatgaaaatagtagaaataaatgccccttctcccaaattaattcaagatctcttagttgtgtgggaaagttccgttaaagcgactcatttatttttgtcaaacgatgaaattcaaaaaataaagggttacattccagaggctttgactagcgttgcgcacctaatcgttgttgaaaatgacgatgcacaacccgtcggttttatgggcattaacgatcattttttggaaatgttatttatctccgctggctatcgtggtaagggactaggtaagcaattattagaatatggaataaccaattatgcagtggataaacttgacgtaaacgagcaaaatcctcttgcaaagggattttatgaacatatgggatttacggtttaccaaagaagcgaattagatggccaaggcaaccattaccccatcttgcatatgcaaaaagattaaaccaaaggcgcattattcaagttaaccgctaattcataaccaacaatgtctgcgatgaataacgactaccctaacatcattgaaattaaaaagccgggaaaaattcccggctttttgtttagtcttatttaaataatcaacgtcaaaatcattaccgtaaccaatccaacaatcacggaaacggccatcgaacgcgtccagtaggcaatgataattactactagtgcgcctaagattaacgctaagtttcctgacgtaatcaaagtatagtcacttgaaataaagattcccttcacgacgagcgccgtaaataatgaaatcggcacgtatttcatccaatcgttgaaccaatcgggaatctggcgttttgaaaaaaacagtagtggcaaatatcgtggagcaaaagccacaaaaaaaccgagaattataatcaataaatgatcaaatgaactgaactccataggtgatttctcctaccaaacttaaagaatatctgattctttcttatcaattttttcgataatcggtccgcccttacgtgaaccaattgcttgcagccacatactggttggtcgctttttaaccaataactcttctgtcaaaaaaccggtgaaggaagctagcagcgttgaaattactaatcctaaagtactcttagtaacaatcatgcaaatcgctgcgagaactccagaaaagatacaaattactaatgatagtcgagacttcacttgcattacaatcatgtaaacgaaaagtgcagttagcgcaaaatccacgacggtcaaattaattttcaagacgctcccgattaacgaaccaatcacgttagccacggtccaaaatagtaacgaccagtgttcaacttgacgggcgtcgttgggggtccaattcttatctgtagcaaatttcaaataatttaccgcgtaattttcatcatttaatgaaagcgcgaatgtaaatattgaagtatgactttctccctgtagatacttcgacaaactcgatcctagtaaagcataacgcaattcaaggaaaaaaagcattaaaacaatcgttagaatcggtgcattcaccgttaacatctgtgcaattaaaaattgggctcctccggaaaagataaccaaagaaactaaaccggtaagcaacgtattgaaaccagctgcgtgcaataaaataccacatgctaagccaattggcgtgtaacttaagcaaagcggccacgcaactttgaaggtttccttccaacgtgcctttgtttcaacttgttccaaagtttgtcctcccaaaaaaattagatcttttaagaatatattaattttttgcaaagcatacgaactaattttaacatgcaaggttggtttttaatagtagcagcttggaaaacctgcgaaccccgttagaatagctaaatcacgcgcttggtgagcatgattcatttgatttctcgccttaatatttcaaaaatgagtcactatcttttcaaatttcatagtgaaaccatccggaaattgtgcgacctaaccgaacccaccaacttgccttttgcacgtcgtgtaccggttttaattgtaccttacgcacagacttatttggtagaaaacttaacgaagcgccagtaagccgtcccgttgcaatcacctgattcttatctacgggagctttagtttttgtggactttagcttaacctggtcgagtttcggcatttggccgccctttttagctttccaatacaccaacggttgtgccaaccgtaacttaacctgccgctgcttagccgaatccatcactacggaagcttgatttttcaggttcgtttttaccaccgtcaaattagtcatcaaagcttgccaaattgccttcgtatcggtaaaacgatggtctgttttcgctcctaaaaccacactaattatccggcgctggttgactttcccggttgctgcgaagtcttcccccgccgctagcgaggttcccgttttcaacccgtcaagttgataccggttgtcatactgcgctccgccaggtagtaattcattatggttaatcatcgtgaccttaccactgccggtgtcaaagtctaacttttgaattttggtaatctgcagaatttctggaaattctttcaagacgtgttggattaccactgccatatcatttgccgacatttgattttcagcatttttaggtgagatagggtatttttcagcaccgacctgattttctagtaaaccagctgcattatataatttagcatccttaattccccagcttcgaacggtggcacgcatttcgtcgacaaacttacgcgaactgcccgcttgcgcctttcccaacgcgatgattgctgcgttagcggaataaattaacgacgcatccagcagatttttgacggtgtacgactttcccgccgtcaaaggaacgttggtcaattcgctattttcactaattttagcgatatcagcgttaatttttaccggttggtcccaccgcattttaccactttgcacgcttttcatgattaagtaggccgacaatactttcgacattgaagcaatcggtaagacttgatcagcgtgcttctcgtacaaaacttggcccgtttccgaatcaatcgctagcgcagactttgccgttatctctggattcaccaacgacgacgtttgcgtagctgccgcggccggagtgactccagtggcaaataatagcagcgtagcgatcactaataatacttttttcatttctactccctttaatacctatgtaattaaaaacgctagctggcccatttttcactaacttaaccaccaatcgaatggctgaaaaattggagatcgttgtctaacagagccaaaacgtgcttcaaaagtcagtttgttgcacttaaccaaatccccaccaatcgcctagcccgcgattaatgggggattcaattaatgcccgcaaactacccagctttggtttcacactccattaatcgaacggcctccaccattccacttacgttaattagcccgattgaccactagcgtcttcgctatttttattttttaatatttactagttggctgtgccccccgcaccggttgctttaacggcaactggatgataaaactagtgcgtttatcatttgaatgggcctcgatggttccattatgcatctcgacaatgctttgcgcaattgccaaccctagcccagtcccgccggttgctttggatcgcgattcttccacccggtagaaacggtcaaagagcttacctaacgcttgggcaggaaccttctgtccgtcatttgccacctcaaaaataaccgtatcgttaatttggtgcgcgtttaggtaaatgtgcttgccgccagcgccatatttcaacgcgttagtaatcaaattattgaacactcggccaatcttttcagcatcccccatcatttccaaatcctcgggaacgcacgtcgaagtaattacaaaccccttttgcttagcttccagctcaaaactggccgccagctgttgcaacatggagtcaacgtgaatcttattgtaatttaacttcggatttgattgactaaccttcgtatattcaaacagatcttccacaagcgatttcatctggaccgactttaaatacgccgtgtgcgtgtacttaaggatatcatcggtactttgatactgatgatcctcaattaaacgcagatagccgataattgacgtcagaggcgtccgtaaatcgtgagacacgttggtaatcaggtcgtccttagattgcttgagagcccgttcttcttccatcgaactgattacgctgtcgactagcgaattcacactgtccacaacccgttggtgatccccgcccaattcaaacggaatccggtggtcaaagtgtccgttagcaatgtaatgcaattctgcaataatatgccgcaactgcatttgtttgtaacgtcgttctagtcgccaatacagcacgcctagatcagctaaaaacattatggcaataaaaatattttggtagctccaaatttggattccaccaatgcggatggaatttttaactaggaaaatcgcatttgacaatgcagggtttgtttttaacgcgccatcaatcaaaataaaaactgataaatttaataacagcaaaaggataatggtaatgattccttcgccaaataattcgtatttttcacgacccgttaacttcattcacttgctccccaaaaatctagtgtgccaccactttataaccaacgccccagacggtttcgattactttttcgccgcccgttgcttcttcaatcttatctcgtaaatgacttacgtgaaccatgaccgtcttcgcggaaatgacgctttcttgttgccaaactcgttcaaaaatttcgtccgcagagaaaacgcggttcgggtgactagctagcaagtataaaattccaaattcaagcgccgtcaactggaccgctttgcccgccaaagtcttaacttcgtgagaatcactattaatcgtcaacggaccaatgtccaaaatttcgggagcgtcatcggtaacgtccttttcgctccgccgtaatagtgatttgacccgagccataatttccaacggattgaacggtttggtaacgtaatcgtccgctccggtcagcaagcccttaattttatccatatcgtcagttttagctgacaacatcaaaattggcaattccgaatctttgcgaacttcccgcacaacctgcatcccatccatctctggcatcatgatgtctaaaatcattagcttgatgtccggatcagtatgcaacttggttaacgcttctttaccattgtaagctgatacgggttcgtaaccttcgttcttaatgtaaatatctaataattcaacaatttccttatcatcatcgactactaaaattttcatggtttatcccctttaaaatttacgctcatttactatagtctagcaaatttaaagataaatgcccgaatttaagcacgtttttttagtaatccttaaaaaaaacggaaaaatactggccttataagcaagcgccttctaatttaagcaactggtgcttcattggggagcctccccgatactgaccaagctaaccgctttttaaagtcacccggtggcacggaaccacgattaaaagcgggttgcgcgctaccgccgttgccacggcacgaacggccccggagcggttaatttgttgggctagttcagaataactaagcgtggttccccgcggaatctttaacaatgcttgccagactgaacgttgcaaatctgtcccattttccatatccaaggacaagtcaaactggcgccgcgtcccttgtaaatattccgcaagctgctgcttggccggcaagttagctgactcatcctggattaacgtagcggttggataaaattggtaaatttcagtcaactcagcattcggcgttcccacaaaagccaatcccgctgccgtagagccaaggtagtaacgagcggtcccgctggttagcgatgtgtagtaaatttccatattttcctcctagaaattaaggtttgagtggataaaaagagcgtgtgctagaagtcgggtaattgatgcgtattaactaaaaatcgaccattatgcctaaatttgaatttggcataatgatcgattttaggtcaagcggagcaaactgacttttggctttcttaaaatcaacacgccaaaatgattttccaaaaaattttattcctgaaaaggagttttccccggcttctgaagaatgttcagtttttatttatggtaattaggagctaacttagtcatttgtacgtcgtgcgggtgcgattcgaccaacccagcattagtaatttggatgaattgcgctttctcagctaaatcggggatcgtggcagcccctacgtatcccattccggaacgtaacccgcctaacatttggaaaatgattgcggcaaccgagcccttatattctacgcgagcttcaattccttctggaaccagtttgttagcttcgttaacgccgccttggaaataacggtcggcagaacctttttccattgcgccaaccgagcccattccccggtatgctttgtatttcttcccaccgtcttcgatgatggaaccgggcgtttcgtcagttccggaaagcatgctacccaacattacggcatttccaccagcaaccaaggccttcacaatgtccccagaaaacttaattccaccatccgcgatgatttgcttgccatattcacgagcaacgcctgccgcgtcgtaaatcgccgtgatttgggggaccccgacgccagctaccacgcgggtggtacaaattgaaccaggcccgattcctactttgactacgtcgacgcccgcttcaaaaagtgcccgggtgccttctgcagtagccacgttacccgcgattaaagtttgatcagggaagtgttcacgaatttccgcaattttacgtaaaactccggctgaatgaccgtgagccgtgtcaattacgatggcgtcaacgcccgcttcaatcaacgcttccgcacgttcaaacgtgtcgctagtaacgccgacagcggcagcaattaacaaccggtcctggtcatcgactgctgctttaggattatcgtcaaaatcaacgtccgctgccttaacttttcgtacttcagcggcttgttgatccgcactcatatttttatggatgacccctaagccaccttgacgagccatggcaatgcccatcgccgattcggtgaccgtatccatccccgcactaataattggaatattaagctttaaattatctgctaactgcgtcgtaatgtccgcctcgttgggcaacacgtggctttcgccaggaattaataaaacatcgtcaaacgttaatccttgtttcgtaaacttattattccaattactcatcaatactctcctttatttatccaaaattatagtaaaccgccaacaatgtgaaactttcgtctaagataccaccgaccagcgaaggctgcaactgctaatatgatgtaaccagccaacggcagcatcggattaattgctggtggcagtgctccaaaggccgtgtagaaaataatccacaaaattaccgccaatacggtaattccggcttgcttccacaaagaaggccgttttttacggttaacaaacaaccgataaatataggcaatccccaatccgccgactgccgaagttaagataattgccaaaattccagctggtccaggagctgcctgcaccgacttcggttggatcaacatcattaacgcgtacattgccgcaaaaagggccatgaagataaggccgttatcagcggcgcgaagccagatgttattgctttgagcttccattttagcctttttaggaccttccacaattgctttaaaccggtcagttggggtcccaaacaattgttttgcggtcgttccctttttttgtccttctaacaattgggtttccgtgtcgattaacgcagcttggcgttgttcgtcacttaatttgcttgcctgtaattccttacgcaaacggtgcataaaatcggcgttacgtttagttaattccgtcgattgttgatgttcagaatgcggatgccgctgttgtgcacctgcgttacgtggttcttcactcatgtttaattgctcctcatccagtaattttatacgttgaagcggaattcgataatgtcgccatcttgaacgtggtaatccttaccttctagacgcaagcgtcccgcttcccgaactgcttgcatgctgccatacttatccaagtcgtcaaacgaaacggtttccgcacggataaagccgcgttcaaagtccgagtggataattcccgcagtttgcggtgccgtcatgcccttcttgaacgtccaagcacgggtttccttaccacctgccgtaaagaaggtttgcaagcctagtaagttgtaagaagcttgaatcaagcggttcaagccaggttcttcaataccttctgcttcaaggaattcagccttttcatcgtcttcaagttccgcaatttcttgctccgtttcggcagaaattcctagaacttgggcatcgggatccacttcggcaacgtaatccttaatttctttaaagtacttggaactttctggatcggccatgtcatcttcggcaatgttagccacgtaaaggactggcttagtggtcaataagaacaagcccttcacaattggcatttcagcttcgtcgaattccactgcccgagctggtttgccggcttcaagaaccggatgcaatttttcgagcaccgccaattctgccaaagcatccttgtcacggcctttagctgcccgttgcaccttagctaaccgtttttcaacactttctaagtctgccaaactcaattccatattgatagtttcaatatcttcgatggggtcgactttaccagataccgtcgtaatgttgtcgtcatcaaaagcacgaacaacgtgaacaatcgcatccacttgccgaatgttttctaggaacttgtttccaagaccttctcccttacttgctcccttaacaattcccgcaatgtcggtaaattcaaaggtggtgtgcacaattttctttgccggaatgatttcttgaatccgtgctaaccgcgcatcgggaacctctaccatccccacgttagggtcaattgtcgcaaacggatagttcgccatttcggcgcccgccttcgtaattgcgttaaataaggtcgacttgccgacgttgggcaagcccacaataccagctgttaatgacatgttaattacactttcctttcaaaattgcgtgttcttatttctatggtatcaaaaaagtggtctagataataggtggtgactagattaaaacggcaatcccacaaatgtttttttctttgttttatgcctgcgttcgcttcgccgaactgcggaaatttacgctcgggaaccctcccgttattttaaacgactggcaccggcttacgcgtttagtaaagccggcaaattagcttgctagtgctagctcaggcataaaaaattctaaattttctaagccaacctcgctaaaagtaatttagcttacaaaaaagaacacatctcatcctttacccttccaaacttaattgaaagcggctgataatgtgttctttccgtttctgacgcaaaataagtgtctgctgacgaattttgcaacattaacgttcgtcttcgtctggcatttcggcaattacttttttcaacttctgttcaaattcccgccgtttaagcatcacgatgtgccgacaacctaaacatttcatcttaatgtccattcctaaacgaatgatttcccaccggtttgtgccacaagcatgttttttcttcatttggacaacgttgtgcaaatcgtattccatgataacttcctccctaatctagtgaaatatgtaatagttccaaaatacggtttaaatcattcattgattcgtaattaatttcaattttgcccttttgttttgaatgggccactaccaacgttttcgttcctaaacgttcggccaactggttttcaatctccctaatgaacggagacttgcgttgttgcgccgttttagattctgccttaggcgctttcgttgcgttgatctggttgacaatgctttccagctgccgcaccgtcagcccttcttgcaccgtacgttgggcgagtttttctagttgccgttcttgtttaactgctaataaggttcgcgcctgccccattgaaatttttcccgattgtagaagctccttcacggaagttggcaaaccgagcaaccgtaagtaattggcaatgtaaggccgacttttgcctaaacgctcggaaacttgagcctgcgtcaatcccagttccttaatcattgcttgatacgcttcggcctcttctaaggggcttaaatcctcgcgttgcaaattttcaacgatcgcagcttcgcgagtggtctcatccgaaaaatcacggataattgccggaacttttgttaatcccgcaatgatgctcgcccggtagcgccgttcacccgcgataatttcgtaacgctcaatcgctgcaattggttggcgtaaaactaacggttggaaaatccccgactccctaatggaatctgccaactccgctaattttttcttatcaaaaatccgccgtggctggaagggattgggacgaatcttatccacttccaccatctggtaactagcattttctggaacgttcaattgtatttctaattgtttctcattcatgataaccttctatttctcgccaattggatctttacttggagttcccggtttccgcggatacttgttgggcgtctcctttttcttttcaattaccactaaatgccgttcgtcgccggtcaccggcaaagcaaattgccgatcttctaataatttcccgcctaaaaccgcgattgcttgccgtccggttgccagctcctgttcagtgtgggccgccttgagcgcgataaagtggccgccttgcttaactaacggcaaacataattcgcttaagacactcaaccgcgccactgcccgggcggtaactagtgcaaaactagcccggtacgccgattttttagcaccaaacgtttcagctcggtcatgaaccaattccacatcagttaaacctagttcatctaccaacgcctgtaaaaatttaattcgtttatttaatgaatcgacgatggtaactttcaattcgggcaacaaaattttcattggcaacgatgggaaacctgcccctgcgcccacgtcgcataacgcgattcccggagtaaaaaattgtggcgcctctaatagcggagttaccgagtcgtaaaaatgcttgaggtaaacctccttttcgtccgtaattgcggttaaattaacgtgttcgtttgtttccactaatcgtttataataggtatcaaattgccgcatttggtggtcactcactgtccaccctcgttcggcaagtgcttgacgaaatttttctggattcatcttttctctccttgtgaaacattaattgtttcatattcctaactccactttacccaattcccccagttttggcaataagtcaatttatacttgaaaggaaggattatatgcaaccaaccatccgcccggtaagcgcgtttaccccacaacactacgatctgttacttttggccgacccctccctgaaaagcatcgccagctacctatctcgtagtaccgcttttgaaatggtcgcagttcaacgtttaattggcctcgttgtggtacgcccgctcactaaccaaactgctgaaattatgaatctggccatcacgcctaaatttcagagacaacattttgctagccgattactggaattcgtgattgagcacgcccctaagacgggaatccagaaattgcgcatcatgactggttcaactagttttacacagctatacctttaccaaaaattaggtttccgttgtgtcaaagtgttgaccaaccattttgttaactcagcttactatcctgagccaatttacgaaaataacctccgccttcgcgacgcaatcgtccttgagcgagacttactttccgattaaggagctttttaacacaaaaagcccgcaactacattgcacacgtagctggggcttgcttaattaattagttagtaacgtacggctttcctcacgccttggcataaatttaggcacgcatctttttaacttccgcaataaaccacttattgaaagcagctgcatcgatgtctacacatacctctgcgttagttttgccgtcgtggtaagcaccgcggatatcggcaaccgtttcaccaatcgcgggtccttcggtaaccacgtcaacccagtacgcttccgtttgatacatctcgggattcaaaatatacgctaacgtatttacgtcgtgcatcggaattccaccttcgttaccttcgtaatagtgggtgaaaattgctcccaacatttcccctggcttgcctaaagttttgatggtagcgatggtttctggcgtaagcaaagccttcatggtaacgtccaggccgaccatcactactggaattccactttggtaaacaatttcagccgcgtgcggatccgtaaagacgttaaattcagccgcactggtcatgttgcccattccgattgcgccgcccattgcgacgattttcttgattttgcccttaacgtcgggatgttccttcaataataaggcaatgttagtgtatgaaccagtcggcactaaagtgattgggtcatcgttagccataatggtttggtaaagaacttctactgcgttgttagccggtacctctgcgggttcttcaccaaagtcgtagcccggcatcccagattcaccgtgcacccgagccgcatcttcaaacggctttaaaagcggttgttcagcaccactagccaccggtacgtccgcattaaagaacttaactagttttaaagcattttttgtagttttatcaaccgttacgtttcccgcaaccgtcgtgattaattctaattcaatttcaggattgttgatggcaaccgaaattgcggctgcgtcatcaattcctggatcagtatccataataatttttgttgtcatttaattacctcccaaggttttatgaaagcgtcctcattaccattctaaaaaaagatgaactccgagtccatcttttttctttttctagttttgaactagtttaccaaacgaatactccgatgaatccagcagatagtaaggaaactaaaattccagaaagcaacatgtaaccaacgtttttagaaattacatcgttcttttcccggtcaactaagcccttgaacgctccgataatcattccggtagttgagaagtttgcaaacgaagttaagaaaacggtgagggttgccaagaaatgtggtgtgaagtgtttcaaaattggtgaaaccttacccataaccacgaactcgttagtaactaacttagtacccatgtattgagccatttggaaagcgtgactcggatcgaaaccaagtagccaagcaaatgggaacataattaccccgagaatgttttctagtgaaagtgctgggttaatcttgcctaataaagcatcaatcaacgctgccaaagcaacgaaggcaattacgttagccgtaatgattaagattaaacggcccgcgcctaagattgaatcacctaagaacgagaagaatggttcccgagcaggcttcttagcaacggtttcttccgcaacttcttctgaacctgattcgatggtttccgtagttgctccagtatcggcactgctaccgatcttagcaattgtaacttcttcttccgttactgaaactggattgagcaccgtggtgacgataattgcgttgataatgttaattggcaccgcggcaattatgtattgaccaggcatcattaataggtacgaacctaaaattgaagccgtaacacagctcatcgacatcattgcaatcgtaactaaccgcgccgacttcatttgccgtaattgtaaaccagaaaccgccaaagcttccgtattacctaagaacatcatttctacggcaaagaatgattcaaactttggttggcgagtaatgaaggataatcccttaccaacccacttaataatccaagggagaacgccgatgtaggtcaaaatatcaaataatggcacaatcatcaagattggtagcaacgcactcgttacaaagttcatttgctttacgtcgacccaatcagcaagtgcaaaggaaattcctttatacgaaatatcaactaaacctttaaatccatccgcggcagccttaactgcgttaatcccaacggtagagttaactaagaaccaagctaacacaatgttaattaccaccatgataccgactgatttccaatcaatatgcttgcggtctttagaaaataggacggcaacgcccaaaaatacgattattccaatcacatttactgctaaatacataccgaatatctccctcttacaatccaatttattaacagatgttgtaataatcataacggcaaatatttagtatgtaaataaaaaatctaaagattttgaaaagattttcaaaatccaatcaattgctattgtggtccgttccaatttgtggtaaatcgttttacctaacgctgccaaaaaccattaaccgctttctttaggtcaaaaatcgaactgatttggcgataattgctccaatgtttcggaaatagctttaagtaccgataacccgcaaaacgttgatccatgagtaccacgtttccccgatcacgttttgtccggattaaccgccccgccgcctgcaaaacatgattcattcccggcaactgataggcgtattcgaatccgtggccgtttttttcgtcgaaatagtcccgcaataaattccgttccacgcttagtccaggcaaccctacactgacaattccaaccccgatcaattgttcgtcagttaaatcaattccttccgaaaagattccgcctaatacagcaaagcctaccaaggttgttgccgacggggtccgaaatttatccagaaatgccgttcggtcttctggggacatttggttattttgctgttcaacctgcacttctgggcgaagtacacgaaaggcactggcaatctggtctaaatacgcgtacgacgggcaaaaaatcaggtaatttcccgctttagcgcttactaacgtatcaattgaagcaacaatttgtggcagactttcctcgcggttggcaaaccgggtgtcaatgtaatcggtaatcaagatattttgctgtcgttgctcaaacggcgagtccatccgcaaggataaagcatcgctgcttcccaaggtttcctggtagtaatcaaccggacttaaggtagccgaaaaaaagaccgccccgcgtccctttttgagtgaagcatcaaggtacggactgggatccaggatttgttcctgtacgttaattccgacttctgtttttttaataatgattcggtaactttcgtcataatattcagcaatcttcaaatagacgctgcacgcgaagaataccgacaaaatctggtccgttaagtccccatccggctgcttaggcaaccattcccgcaccgcttcgttgaacttcagcattacgttttccaacggtcctaacggttggtagtcgactaaggcttctttattttccttttcaaatgtattttgaatgattgttagttcgttgccgagccggtttaaccagcgcttaaccgtcgaagagtcaacgtcgtgaccactagtttcaaaaagctcttgggctttcaccacttggtcggtgttaatttcagccgaatacatctcgcgcgaacgggataccaagttgtgcgcttcgtcgattaaaaagaaattccccttatccacgttagagaagtaacgttgcaaatatacccggggatcaaacaggtagttgtaatctccaataatcagatcacaaaaaagcgacaaatctagcgagaattcaaacgggtccaacgtatgcttctttgcatacttttgaataacttccttggttaattgattttcgtgatctagtacgtcttgaatcccatcctttacgcgatcatagtaccccagcatgtagggattattttccggattaacccccacctcttctggaaaaataatcttatctttagccgttaacgtaatactctttaacttcaagccaccttcagccatcagttcaagggcctcttcagcaacgtgctgggtgctttgtttagcagttaggtaaaagattcgttccatctttgcttctccaattgccttgatgctggggaaaagcgtcgaaatggttttaccagttccggtcggtgcctccacgaatagccgttgctccgtgaggatggttttatagactgctaccgccagctcccgttgtccagcccgatattcggaaaacgggaaagctagtttttgggcagactggtttcgcacacttcgccaatctcgctgccgccggacccatccttggtattcgttgatcaattcgtcaaagaattcactcagttcctgacgactaaacgtttgttgttgttccaacacgtcgtcggtaggtcgctgataataggtcagctgaatcgtcacttgctcataatctaagtcctgactaaggatggcaccgtaaaccttcgcctggctccaatatagcgtcttcgtgttttcactaagttcatcgtacgttgggtcggaagttttaatttcttcgataaaaagttcgtcaccaatcaccactccatcagcccgtccttcgacggtaagttccgtcccagcaacctcaacgacccgtttgaccgcgtattctttttcatagtctgcgccccgctttttttgcaaccgtcggtgaatctgcgcaccttttaacgctgtattttggctatttgccgtgggatttaggtccccgcttcgcaaaataaattctactaactgacgaattccgatttttgttggtaccattacattctcccgctaattttcttaaataaaaatttttcgttcctcgctaacgtatttacctacgaaaccaatttaggaggaattttatgaattacagatcaatactttttactaccgcaattgcgacgatgggtgcattttctttcggtcactccccagtttctgcacatagcttaccagctaattcaccgctattaacggcctctatttcagaaactccgcagcccaaagtctcccggtcattttccgcttcgtcggctgccccagcggctttcaatcaactcgaaacagttttgaatcagcacctcggacaaccctttgcgtggggcgcaaccggaccgaccgcctttgattgttctggactaactcaatttgcttttcgccaagcgctggggctgaacttaaaccggactgcggaacagcaattccaacaagcgcagcgtattgacgccacagcggtacgtcccggcgacttagttttcttttcctacaaccatggtcaaaccattgatcacgtaggcatcgtggttaatggcaaccatttgatgattgacgcccaaaatcgtggggtgatccgagaaagctatgctacaccttggtggcaaccgtttatcgccggatacgggcgcgttttaaccaaccaataaacatttacagcacccttcgcggtaatttaaagggactggggaaatagacatcttgatcgccaagatgcctaaaaagttccccagtccctttgtgcagtatcgttaagtacatcaattgaagttcagaatccgatcaaaacgcgtttgcatgacccgcttctgagttaacttcaacatgttttaatataatgaacccaccttaaattttaaccaaagtggcgtttccaccaaccttttttaggttgttctaaggccttttggttcttttctactaagtcatcaattttcttagctaacttagcgttttcttcgtgatagctttggttttgctcaacaactttggttagcagttttttaaggtccgccatatcctggctttgggccgtgatgaagcgtttcatcgactcgtccatcaccattggaacactatcgccttcaacttgatcctgttcatcttcaacttcttcatcgtccccgtcgctagaagatgaaactcccaaagttgcttgaaccgcttgtttaagggtgtttttttcacccaaaagctcgttcatcttttctaaaatctgaatgtcttcttcagagtaaatgcgtcgtccacgaccatcatgttggaatttatggccgctacgttccatttcctttgcccagttacctaacgtggcaaggcttccgatccgttcgattttttcaacgacgtccgaaccagttgcatattcatctgcttcaatatcttttgccattatttcacctactttaatgattaattttactacaaactgaagtacaattctagttcaaaaaaggcgatttaatcgggtttgttacttcagtgaacttcaaaattattgcttacttcattcgacaaacctattttactcccgtactggtttcccaacaatctatgttagaatgactaattgagtgaacacaataatcgaggtaatttatgaataacaagaaaaattttaaaacatctaaaccacgttcgcaatcccgaacgaatagcaaacaaaataatcgtcacttctaccataatcccaagagtgctcaacaaattgctgaaggtcaggtaattccgttgaagattaaacgacttggtatcaatggtgaaggaatcggttactaccagcggacaatttgtttcattaagggcgcgcttcctggtgaaaaggtgcttgccaccatcactgaagtgcattcacgctatcttaccggtgtcttacatcaaattaaaaaggcgagtcccgaccgggtaacgccgatcgacgcctatgccgatgaagtcggcggcttcgaactggaacaccttgcttaccctgcccagctagaatttaagcgcgacgtcattcgccaagcgctaactaagttccggcccgcgggttatcaagattacgagctgcggcccaccatcgggatggacgacccggtggcctaccgcaacaaagcgcagttccaaatccggcggctggctgacggccgaattggtgcaggactttataaggaaggtacccatgaactcgttgacctcgcaacttgcagcgtccagcatccgttaaccatgaaaattattcgggcagcggtcgccctattcaccaagtacgacgttgatatttatgacgaacatcataacgagggtgaattaaaaacattggtggtgcgggttgcccaagctacccaggaaactcaagttgttttcatcactaatacaccccaactatcacacgcaacggaaatcattgacgagttaagtacccaatttccagagattgtttcattcatgcaaaacatcaatcctggacggcaatctttaatttggggtgatcagaccgtaaagcttcgcggacaagatacgattcgtgaagaacttgacggattgtccttcaatttatctgcacgggcattcttccagttgaatccccaacagaccgttactttatacgatgaagctcgaaaagcgttatcgatcactccaaactcacgaattgtggacgcctattctggagtgggaacaatcggtttatccctagctagcgaggcaaaagaaattcggggaatggacacgattgctgacgcaattactgatgcaaacgaaaatgcccggcttaacaacattactaacgctcgctatgaagtcggttctgccgaaaaattgttacctaaatggttgaaggagggctttcaacctgatggaattgttgttgacccaccccgcgttggtttagaccggcggctaatcgacgccattttaaaatcagcacctaaacactttgcgtacgtttcctgcaacccatccactctggcacgcgacctagttccactagtgaagaaataccgggtggaatatattcaatcaatcgatatgttcccccaaactgctcgagtagaggcagttgtaaagctaacgctacgtaacgcataatcaaatgaagctggggaaaaccaaagaactgattttcaggatgaaaagatccttaaaaagttattttggtgtttggccttcaacagaaccaaaacgtgcgccaaaagtcagtttgccccactcccctaaataaatacgttaaaaacccaaggaattttctagagcttcaactactggctcaattccttgggtctttttatatccatcgattattctgggcaagttcgactgcttcaagccgatttcggacccctagcttactaaaaattgccgataagtaattacgaatcgttccttcactcaaaaaaagctgttgagcaatttccttagtcggcatcccgctggcggccacctttaaaacttcggtctcacgcttcgttagcggactttgctccgcagataaaacactttgcacgagtgccggatcgtaaatggtttttcccgtcatcacttgattaatcgccccaattaattcttcacttgggctatcctttaataggtacgcagctacttgggcttgaaccgcctgttcaaaatacgtttgccgggcaaaggtggttaaaatcaccacgcgcgtgggcagcttttcctcgtgaattcgttgtgcaactgctaggcaagttagccgcggcatttcaatatctaaaatagccacgtcaggagattgtttttgaatcatctcccaggccgtctgcccgtcactggccgtcccaacgacttttaaattatcttctaaatctaataactggcttagcgccgagttcagcatgctttgatcctcagctaaaaatagcgtaatcataatttactcctttgacaattgaacttggactaacgttccaatggaattacttgaaatctgaaattcaccattttgttctcgcaccctttgcaacatccccgtaattccattagcattctcacgggtcaaccgcttggcatgcccattatcctgaacttcaaggtgataattttcgccaacctgattaaatttaatccagacttgggaagctcgcgaatgccggatcacgttggttatggcttctacaattaccgccgctaagcaattctgaacttcagtcggccatttgctagccgcttcttcgtgctccgtaaacataaaaatacgtgcttgagccaagtttttaccctgttccaacaaaacttcgctcagggtctgctggtgcaagtcggcaacgatttgacgaaccagttgaagattggcgcgactagttttagcaatgtcgcgaagctcatcgggaactcgttccggggccttctccaatagtttttgagcgagctccgtttttaccgtaatcatggaaaaactctgtcccaaggtgtcgtgtaaatctcgggcgatccggtcccgttccccgcgtcgaattaaattttccagccggcgattattttgggacatttgttttcggatttggactgaacgggcaaacccgtacgacattattggagaaagcaccggaaaaattaatccaaaagcgttcatagcatattccaccccagacgtcgggttggtttggaaactgtgcacaactcccgctcctaaaagggtgtagtaagccactaaaaaccacccaaaatagcgccgtggcatcgttgaaaggatgaacgcaacctgccaagcggtaaaagtaatcatgaaaaagtttagcggccatacggcaaacgacccagtaattagcaattccagcggaatcgttaccctccgccatctaggtacttcggtaaccaatatgtaaacgatgagaaacgctcccatcatcatcagccaaaaatagtccgtccacgaccggactggtaaatagaatgccacgctaaacggcaagtacattagccaaatgtaggtctcccacttaatctttttcaaagtttccttaaaactacgcattaattgctgaactcctcttcgtaaataattgcgccacccccgcggttaccaacgccataattaaaatccactcgctaattcccactacgctactccagttaattttagcatggttgatcacttgtccaatcgtatgatttaaaaaatacgtgggcaaatgtcgcccgatgttttggacccattctggcattgtttctaggggccaccacaatccgctcacaattgccaaggggaaggttactaagttcattaacattcctaacgtttcttggcgcttaacgttagctagcaccccagctaacagcataattggaatttgccccactaaaattaatcccaataaactcagccattgtaccagatctaaagtaattgcattcagatacgccgcgaccaaccccaaaatccccattgccatgaagtttttaagggtgttccacaataaaaacgaagcgtaataattgtctaagcggtggtgatttaatttcaaaaataccgtcaatccttcattacgatcccggattaaagcagtagacatccccataagcaaggtaatcaacaagctgtacaccatcatacttcccaaataactaccggcaaactcacggttattagttgctggattcgtaaataatttagtgaatagccagtaaaaaaaggctggcatccccagcgacattattaaaaacgagggattgcggaatactagccgctttccatcaaatttcaactgctcccataatttattcatggcggtcatcctccttggtcatcgcggtaaaaatgttttctaacgaagcggcggtgatttttacattatttaattggtttagccacggcgccaaagcccgcagtgtttgatcactatccgtggtctccagcgtaacttgctggccctttacaagcacctgctttacgttcggcagcccttggaaacgagctttaggaagattggttacaaagctaatttgactagttaagtagcctcgctgaagttcagctaaagtaccattgaacttaattttgcctgcttttaaaatcaaaattcggtcgacaacttcctgaatttctgccaagtaatggctggtaattaaaaccgtctttccccgaacgcgcatttgttcaattttacgccagaatatttgtcgtgcgttgacatccattcccacggtaggttcatctaaaaaaagcaactgtgcattgctaaccaacgttagtccaaaggctactttccgcaactgtccacccgacaaccggcttaaggggcgttttgcaaacgaaattaaggccaattcttccattacgtcagctaccgggcgcggattacgatattgcgcagcagtaagttgtaataaatcccgcaccgttttcgccaatcaagccaatgatttctcccgtggggacggttaaattcaccccgtgcaaaaccatttttgaactataattgaacttcaattcgtggacttccacgagtgtcgtatttttcattagcagatcctccataccccatattctagggaattgctgcctccttattcagtactagatgtcactactttgccatgacatttgtcacattttataaaaactgtttaagtttcccgtttgccagaggtttttcgtcgacttctcgcaaccgacccggaataataggagaaaacaccccaatatggaggattttatggaacaacaaattacgcagttcatcaacgactttggttacctcgcaattgtgctcttgattgccttggaaaaccttttgccgccgattccgtcagagattattttgacctttacgggatttatgaccctcacgtctaaattgaccttgtggggaagcgtaatcgccgccacggtcggtgccgttattggcgctttacttttatacgtaattggtcgctacttgaatccggaacgcctacattggctagtagctagccgcttaggtcggggattgcgcctaaaagatagtgacattaccaaagcacaaagtttcttccagcgccacggcttcaaaacgatcttttttgggcggtttgtccccgtaattcggagtttaatttcaattccggcggggatggctaaaatgccggggctcctcttcgtcttgttaaccacgattgccaccttaatttggaacttagtcctcattctcttaggacgagcagcgggcagcgcatgggcggaggtttccgtaatggttgatacgtacgcttccgttgtggcaattttactagctggaatcctcctcatcggcgggttagtttattatttcaaacgaattcgcacaaaagcttaaaccaagaaatcgttttcatgataaaatagggataattataatttagttggggaggacactcacaatgaccaaagaacattatcttaataagcgccgccagcaggaacttttgccgctagtagcgtttgaaatcaccgcaactttcctcgcgtataaagatattcttaccgcaagtagtttccgacatggtaaccgcgccctttggttattagccgcccttatccagccaatcggaccgtggctttactttactttcggccagaaatccgagtaacgtagaaggaagatgaccctgtttgaaaattcaagatgccagaagaaggttcttttggctgacaatctcaattatcattaattctgcagcaaatgctctgaccattgccacggggatggggagtgcagtttggacggcttccgcggttaatattgcacactgggtaacccattccacggatccagccgtggccaatcacgtcatggggaccgtgttagtgatctatggggttgcggtagcctttcttgcaatgctacttacccaacgaatagattggactcgttttgttcgcaacatcctgttcgtggtaccttttagctacctagtacaatggtttgtgccgctttttcgggattttttacggattggtgaacttcaagccaacttcagccacccctaccagcttgcactagatatcattattgatatttttgggttattttgggtcgccaccgcggtttccttataccaacgggccaacctaatcatgcaccctaacgacgacctctcttacattcttcgttttaagtacctgcacgggcgtgcctcggcttcccaatgggcaagttacgtaccgccattagtaatgacggtattgagcttgattgccaatcaccaagtctggtcgtttggttttggcacggtttgggctttcgtcactcaaggatatgtccagggctgggccgatgaacacgtggcgccttctttcaaacaccactttgtgttgcagaagccacggggatgaaagtttaataattagaatatctaaaaaagagagtgggacaaaagtcgggtagtttgcgagcattaactgaaaattgcccattatgccaaaatcaggcataatgggcaatttttggttaagcggaacaaactgactttcggcacacgttttggctctattgaagtcaaaacgccaaaataaaaacgattcatgaggaagtttcaactcatgaaccgtttttttgtttaaagacttttgtcacaacctcttttttaaatttggatgacatatttactcatgttaacaaataattttttcaatccctaacttcaagcccttcattgcaccgccttaataattgcctttgctactagcgacgcatactctttcgagccctctggattagggtgaacgtggtcgccgtagaaccaacccggttggttcttagcggggccgttccaatcgataatttgcagattatcatacttcttcgtagctttattcaaggtttggttaaccgaaccttcccaagtttgggtaggtacgtggacgttaacccagaatagcttccggtgcttaccgaccaccttttcaatagcgtcgatttgtttagcatttaccgggccatttgcgcctaagttaattagcacgttgtcgctcagttgtccttgtttcttcatggaagttagtaatcccggtgcttcatccacctgccgaccaaccttagcggacataaacgcggttgggaagatttcttgtaaatcggctcccgtatcttctagaacggaatcgcctactccagttaatggaattgacttagctgcgcccatttcttggtccgttagatgatacttttgagcaattgccttttcttttttagttaacttaacgtgtttatccttagatttggcatgatctttttgcgcttccttttgtttttttagcgcgacagcatttttacggtccgtagccttgctatttttagcgagcttagcctgtaaatcatcagttttttgcgagactttttctggagcagtgactgcgccaaaaattgccacgaaggtaacaaacaagacggctgccacacctacgtgacgccatttaaatcctgattcgatatcgaacatctccttcaagaaacggcctagatgacgataatcaaactgtgctaacggaatctcaacaaaccggtaggacagttcactcaatactaaaataattactaacggagcaatcgtatttaaaactggatgcgccgcaatgttggtaaccttttgttcataaaacaccatcaccggtaattggtacatgtaaataccgtacgaccggcttcctaaccatttgaaaactggattagtcaacgctcgattccaaataaaagccggatgggcaatgatggcaatcatcaatactgacaataccgaaaaaataaagattccgccatagtaaggccacgcagaagtccctggcatggtgaagaatgacgtgatcattaacgccatgatgatcaatccgataatgttcgcaacggcatttttatgcaaatcaaggtttttcttcaacctagtggaaggccaaataaaagccaacgccgcaccaatcaagaagggcgctacccgggtgtccgtaccgtaataaacgcggttaaccgtgtccggatggtacagaattgccatgatcattgctgaaatcacgctaagcgagaacaaaattcccgctacttgcacccgacgatgggtgtaaatttttaacaacacaattagtaaaagcggccaaataaaatagtattgtccgagtaccgacaaataccataaatgggtaaagggtgactccccattataccggtcaaagtatgactgcccgtgacccaccagccaccagttgtatacgaaggtcaggttggtcaagattatgcttcggatatgcgacaataaattatgcgcgaagatggtcatataagcagtgctcgccaccaacacaacgactagggtcggatataacctccgcagccggcgtaaataaaaagcccctaattttattttccccgtacgatcccattcctgaataaaaatatccgtgattaagtacccagataccgcaaaaaagattggcaccccaagataccctcccggaaccttataaggcattagatggtagaaaataactcctaaaagtgccaacacgcgcaaaccatcaaatccagtaatgtagcggcgcgcccccgtatttttgtattctaaagaaacttcatcaaactctttcattcacgcttacctctaacatccaaaataaacaactttttctcccccataaatgttgattaattatgtacgctcaatgattaatatcatataataaccattccaaatatccaactatatgtataaaacatttttaatttttatctaattcctacattaatgtaaacaaaaagaggaggtttgcataccaaacatccgcccatgaagtaccagagatgattttaccaccccatcatcacttattaaaatcgtgaattggcgtggtaagatagctataactttgaaattaagaaaggaattcttgttcatgaaaaaaatcgcagtattttgtggcgctgccgaaggtgaatctccccgctataccgcagctgctcaacaattaggtcagtacttagcaaaacatcaaatggggctagtatacggtagtggcaaatacggattaatggggcaaattgccacagctgtcttagaatccggcggctacgtcgaaggaatcatccctcagaaccttgccgatcgcggtgctagttactcagcaatttctaaactagaagtcgttgaaaacatgccggtccgcaagcaacggatgatggagcttgcggatggcttcgtggcactccccggaggacccggcacccttgaagaaattgcagaagtgtactcttggtcattaattggtgaaaatgccaagccgtgcgccctttacaacgttgcccattactacgatgccttgcaagaattctatgaccgcatggttaaaaatggattcttagccaaaccgcgcgtgaaaaattactattctcggattcattagacgagatttttcaattcatcaatagttacacccctcctgcaatccggcgatactaagccagaagcgacaccactaataggattgtcacaatcacccggactacaaaatgaggccagttaatattgaaaaaaattagctgcccgttaactaacgaaaccggcaacaccagtattaatccggctattcctagccacggctggataaaatttagcaacattaacgctcccacaatgatgttagccgccataatccaggtctctacctgtgcttcaattcgaagtgcactataaatcaagaaacctccgtataacatagttaatatgattccaacggtatgcgtcattgtggccactccccataatttatattgaagaaatcgttatcttttactaattccattgtaacaatattgcggcaaaaattgagaataaagtttacggttgacatctcactcatttatttatatagttagtcacataagtaattaagtaattcgggagggactttttatgaacaaccaaaatattgttagtgtttcggacttgcgtaaaacttatgggggaaaaaacgaacggcaatacgaagcactaaagggaattaattttgatgttcaaacaggggaatttgtggggatcatgggagcatctggttccggtaaaaccaccctattgaacatgttggcaactttagataagccaactagtggacaggtactaattaaccaacaggacgttactcgcctaaagggaaatcaaatcgctgatttccgttctaaagaaattggttttatttttcaagattttaaccttttggaaactttgacggcggaagaaaacatcgctttaccactttctttgcaaggagttcgtcgcagcgctattaaacaagcggttcacgcagttgcagaaactttgtcgatccaagacttattgcggaaatacccaactgaactttctggtggacaaaagcaacgggttgccgctgcccgggccatcgttcatcaaccagcattactattgggtgacgaaccaactggagctttggattctaatagcgcacgagaaatgttggaattattgacggatattaaccaaaagcaaggcgtttccgtcctcttagttacccatgatccgttctcagcaagcttctgtcaacgaatcctcttcattaaagacggggtcattggccaagagctgcggcgcaacggaacctcacgttctgagttctatcaagaaattcttgaaaaactcggtacgtttgaacagtaggaggtttgcataatgttactcagactagctctttctaatattaaaaaccaccttcgcgattacgtggttttactaactggcttggtaatgtcttcggcaattttctacatgtttgccaacttggcaactaacgagggctttatcaaggcaaatgctaactttaagtttgctagcccagtctttatattcggggaagttttattggtaatcatcacgtttgtttacgtaatgtacgctaattcattcctattgaatatgcgccttcatgattatggattattcatgatgctgggtgccaaaaaacggcgcgttggtagtttgatggttttcgaaaccatgaccgttgggattattgctaccgccttaggcttgctgttaggggtaggattaaccggtggaatttcacaactgctctttaatcaccttgggttagaaattcataaattcaacccggtctatttcaaggcaattctaacaacgatcttgttatacttgattttgttctttattgccgcactgtttaatttacagtctttagttcggaagccagtcttgaagctacttaagcagactgatactgtcgaccgaattaagattaatcccattggactgcttttctctggcgttgctggaattgtcctcgtcgggattggttattacgcgcttgctaagattatggaccttcaactttctgcgattccgattgctttagttaccatcgtagtcggtagtttcttgattttccgctctagcatgacgttaatcatccactggttaaagaactccggatttgcacagcggaagttaaacaacttcaccctttcgcaaatcatgttccggatccgggattacaacaagattttaaccattacttcgttactatttgccttggcattaggagcaattacggttggttccgcctttaatcgtgaaattgattcttcggcgaaattacagagtgcttacacaatggcgctaaataaccctactcctaaagaaaaacaattgatcaacaagttaacggacgtccaagtaactagttacgaccaaaagtttgctaactcacacgtttactacaacgaagatcaatttgaacaacatccgtactatacggtgaaatttgacgctacaactgcgcatcctggtgaagcaaaacgcgttaaaactacgctaaacgatttaaaaactaacgttagtcatagcatggatttcattggcctaggcggttcaaaaattgatactacgcctcaattttatccaacagctaaatttgaccagttaaatggtgaaaagggcaccgtcagcctcatcaccgtcaaaaacattggcgaaaatcggaacactttacagaagctctacgacatgcaaaatagtgcacatccactaccagatgaatttgttagcggagtaggtacttacccagcttacctagtgctcagtggaatttacggtggtcttgagtttatcggttatttcttaggaattgccttccttgcaatgcttgcaagttgcttgatgttcaagattctttctggaactcgccaagataccgtgcgctataaccttctaaataaggtcggaacgcgacgttccttaatgaagaagagtatcaacaatgaaattttcgtcttgttcgctcttccaggaatcttgggagtcatcgacgttttgtttggacttcaaatgtttaaaccgttattgcacgatccgtactaccatatccaatatccaataattattttcgtggtggtatatctaatttactacctcttgactacttggatttacaagttaatcgtgttaccgaagaagaaataacgggaacaaacgcatcaatcggggattggaaaaactacattcagtttaaaaacagcaaaaagccttcaagaatatcttgaaggctttttgctgttaacgggttaatataattatttacgtgttaaaacgagtcccagaatccagctcttctagttaaccaaactaaggcattgaccgcttaaaccgcggtcaataccttggttgcgttaatcttcagaaactattcgggttcttccactctcttttccatcattcacaatcatcgcatgaaaatttttccactgttccggtgttaaatctaattctgcttccaccatttttttcgctgcttcatatcctttaggtaacgggcagcccattctttcaaaaagtcttctactgtatttatcggcgataaatcccgcgtgctcaaatgcatacatcatcacgtaatccgccgtttctgggccaatcccgtgtaatgcaagtaactctgctcgaagttggcttgaagttaaattctgaatccgtgaaactgaaaaatcgtagcccttcgcccattgtaaaatatttttaatggtggccgcctttcgcgtataaaacccactcggacggacattttgctgcaattcttcgtcacttaattctaaaattaacttcggattgaagttaaaatttaatttcaagttgtttaaactagggaccacgtttcgccaactagtattttgtactaaaattcctccatacacgacttcccagggtgtttcctgccattcttctagccaaggttgcttccccattcgagcgtacatcgtttgataaattgttttaacctgcaccgctgccacctccgtccccattatatcggcgaatcttaaaaaaattattataaaaggcctaaaattattaaatttgcgttagaataggagataattaatataaaggagtcctgaatttgactgaaaaagcctgcacaaccgttttagttggtaagaaagcctcaatcgatggttcgaccatggtcgctcgtaacgacgacacttttttgccactcgcaccgcaccgtttttacatgcatcccgctgaaagtggcgtagacgaaaccatcgtctcctcacaaaacgggtttacagcaaaattacctgctaatggctaccgtcatagcgccgttcctaacatcgatcctgatcgtgatggaatctatgacgaaagtggttttaacgaaaagaacgttgccatgagtgccaccgaaagtgtctacggaaaccctaagaccctggcgtacgacccgctcgttcctaatgggcttgccgaagacaccatgccaaccatggtacttccttacattgattccgcgcggatgggcgtagaatatttaggtaagttaattgctaagtgtggttctcctgaaggtaacggcgtcatctttagtgacaaggatgacgtatggtacatggaaatcgtcacggggcatcactgggttgctcaacgaattcctgacgattcttacgccgtagctgctaaccaagtggcaattcaacaagttgacttcaacgaccctgacaactttatgtggtcggaaggcattcaagaattcgttgaaaaataccatttgaatcctgaccatgagggttggaacttccgtcacatcttcggtaccgatactgaaaaagaccgacattacaatactccgcgggtttggtatggacaactttaccttaacccagaaatcgaacaggacccgcaatcttcagaattaccgttcattcgtcaagcaagccgtaaaattacggttgaagacgtgggcaacattttgagttcgcactacaacgaaactaaatacgatccgtttggtcatggtgatgacaaggatcgcttgaagttccggccaatttcaatgaaccggacccaaaattcgcacgttttgcaaattcgtaacgacgtgcctgaagatcgttccgcaattttctggctcaacttcggtgtcccagcatttagcccatacgtgccattctttaacaacgctacggatactgatcctagctacagcgctactaagcaaaccatgaatttggacgatgcttactggatgtaccgcgcggttggttccgttgtggaagggcactatagccaattcatccaaaagaacgtggactacgtaactgcttctaaagaattcttgcgtggccgggttgctgaaattgatcgtcaagccgctgaattgtctggtgaagaattaaccaggttcttaaccgaagccaaccatcaaaccgtggctgcgatgaaagagcgcacaatgaagcattttaacgatttgctcgctactggattaacgctttcgaaattgacgtttaatatggataagaatctttaatacgaaaaaagagactgagaaaatattctcagtctctttttttaggaaaaactgcttctctgctgcctagtcaaaacgtgttccagccaccaattttttccggttaaccaaatttggaggctaatcgctcaacccgcgactagcctccaaattcagttaatcctcgaaaattacccggtatcttccacactctaattcttttcaatcgcccgcggccttccccaatagtatccctgctgtagcttaatactattgtctactaaccagtcacttaccgagaggttatcgatcccctcaataatcaagtcaatctggttatcaattgccattgagcgccacaacatcaccgtttcttgcactagatctttacttacgttgcgtaattgcaacaatgacaacttgatccgatcgatatattcaccatactcacgaacaatattaaaactattcattccgctagaaacatcgtcaattgcgatgcgaaaacctagctcgtgaacctgcttaattggttcaatcattgagttattgtaatattggtcgaaataccgtttacttgggattgcttccgtgatttccaccatcaaggtcttttggtatggaattaaagccttcaaagcctcgatagtgcttgggtataataattgttgcgggtcaatgttaaaactaaaatattggtctggcttattttttaccaactcttttaattcattggccatccaattgcagaaaatccgattactctcgttattacgaatgtattctttaaagagggccgctggaaacttattatcttccccagcttcacgtaacaataattcatactcttggagcttccccttggtatcctcgttattcaccgcaaagattggttgttcgtaaaaacataacttatccactgcggcttctaattcatccaacttgtccttctctaacttaatgacgaaacatccccctctacagacatactattcctagaattatttttagcttgatataaatatttgtcaactcgtttataaaagtctttggcgctttgatcactcttcttaaggtcagtaaccccaatcgatactgtaatccggacgtcaaggccgtctttaacttcaaaagtcttctcaactagaatatcacgaatcgccttcacaatcggtgcagcttcggcagacgtccggttacggaagataatcgtgaactcttctccaccaactcggaaaagctgcgcgttggttttacgttcgaacaattcatccgagaatagctgagcaacgtattttaaaacacgatcgcccacttgatggccatattgatcgttaaaaagcttaaagtggtcgatgtcaaacatcgccatcgctaccggtaaatcattgttagagtaaacttcaaatacctcattggacacctcgttaaaggtccgccggttacgtaccccggttaagaaatcgtagccgttatccttttccaatttcatataccgcttaatcattgcccgaatttcgatatttccgaaatggacaatcgtcatcatcagcataaattcgaacgttagcaagagtacttgactaaccgtcatggtgcgaatccccttcaagattgaccaccaggcaactccaaataagaactgggtcgcataataccaggtgctatcaattagccattcactattccgataaaccacccaaattattgcgattaaaagcagcatcgccaacaaatttaaaatattaaactgcgtctggtgtcgaataattgccaaaccataaatataaattggcaaacccatgttaaacaaaagcaccgttttgcgatgcacaatgtataggcagtaaaacaagatgatgaactgcgcattagagtactgccaacccagttggctattgtcaatatccgcatgtagggccataaaagtcgcctgcataaaaagcatggcaattgctagactgacaaaccaactaatctcttcataaattgccgtgttggtttcgtacctgccaaaaaagcggtcaatcccgtatgaaaccaacgttaaaatgcataaaacaccaatcgtaattgcagcaataatcaacgtattaaaactaaaaaaacgcgcaaaccattgtccaattggacttacaaccatactaaaaggcattttaatatctcctattcttttgctattttaatcaaggcgtccacgtagtcgttaacaacgaaataaccggtatccttcgtttagcgcaagaaaattatacataatcttccctacccacactaaatgcaaaggcttatttctaacattccacattgccaaaatcaaaacttaatcttccaataaaaactaatctttgtaataacccattgcgttatcagtttagtggcgcaaaattgcaccatttccccgatatcgacgactaaattatcgttcttaagtatacgatttttattagatattttgcaagttaatattattaaaaattaacttgtcaaagtattattttcagcacgcaacttttgcatgtaaaaaaatacccctgaagctacgagatatcgctgcttcaagggtatttttatctgtccgagacagtggtgcttaggtgctttactttaacatatcttcggcggtcttctttaggtcagcatcgctcatgctttcccacttcttggcttccgcaattgtcttaaccgtgttgtgaccgttcgaatccataacgtggttccacattgcatcacgtactggagttgaatcgtcactccaatcaaatacttccttcatttgtttatccaaaagttgtgtcttcaatgtttctgccataataaaagcctccaataaactgggtgaccatggttaaaacctaaccatgccgttcattttattattgcaccccacgactctgttataacactggttgggcgatttgttaatatataaaattggtttgttttggttgtgtatttgtcgggtatgataacggtttatcagtccccaaaacacaaagaagcgaaaactgcagataaaccgtttccgcttcttgaacttaaacgttatttttcttgataatcaaaatacccaaattgtgccggtacttcataacctgaataatccacggcagctaggccaacgaatgccccggtaaagaatccgccgtaagtttgtaaaacatagtcatctgacaacacggccgcatctaactcaaccggaatccgctgccattcctgaccatcaaaagagtactcataatagtaagcttgtttttccacttgcgttctcagccaaacttcatcaacatcgtaaggaaccttaatggcgtggtccttcaaataagaagtgtagtttccacgattattttcggccacttcgataacttttccacgattttcatcgcgcgtaatgaagacccatgaccagtgtttatcattataaaagttagttagcccggccatctgctggtaactaaacggatcaaatttaaccttagtttctgcagtaaaattgaacgcctgccagcgttgggcaatcatcgaaacgtcaaaattacttgctaatgatccacgaccaaccagctctagataacccttcccggtatggcccattttagccgtgaacggtactcgaagcgtattccaatctaaatccaatgctggttggtcaaactcgtcgtggcgggaatggtcagccgaacccgcggacaaaatcgcgtccttaggggcttctacttcaacctgaccgccatggccacccacaattcttggccatccttgatcatcccattctactttttgaatggcggtttcccggcctaaagtactccatccccggggatcgtggcgggattcgttcgcgtggttccatggtcgcgcacataacgatgcgtagtaccattctccactaggcgtgttaactagtgctccatgaccctgcttttgtatttccatatcgggcgtgtcaaaattagtgatgaaaggtccgtctggctcagtttcaaaagagtttgcgtctaaggttttagaacgagcaactacctcttgatgagtgaataccgtgcccccttcagctgcaaataaataatagtagccgtctttttggtataaatgtggtccttcaactagcttaacttccgtaccgcgataaatggttcgcgcggtctcgggctttagtttcatggttgttacgtcaaattccgtcagcgtgattccgtcaaatgggtgatgatattctcgatggtcccaagtttgctgaaccaaatatttacgtccattttgatcatggaacagcgaagcatcgaagcccaccccgtttaatttaatcggatcgctccacggtcctcgaatatccgttgccgttgttaggtaattggtcatatctttaaatgcaccttcggttaccttcacgtcggtgtaaaccagccagaatttaccatctgcatatgacaaatcaggtgcccaaattcccccagaagcagggttccctttcatatctaaaagggtcgtcgtggataatggtgatggcaaaagttgccaatgcaccatatcttttgactcgtgaagtcgcacgccaggaaaccattcgaacgtggagtttgcaatataataagtgtcaccaaccctaatcatgctagggtcggcattaaaacctggtaatactggattaactattttcattttaattatcctttctatataaacgatttataattcaccttgcgacttacgctggtcaatttctaaattgatttgctttacgtcaagatcacttaacggatacctactcataatccacattgctactactgccaatccaatcggaatccagatcattgaccattggatccccattagtgaagaggaattttggactgccttagtaccatcaaagtggaagaacgcgttgatgtagcccggaataattccacctaaggctaacccaatcttgaagaacaggcccataatcgcgttaataatccccgcaacccgttttttagattggtattcaccgtatgaaactacttcaggaaccaacgaccacatgtaaccagttgcagaagtaatcccccattgttgtaagaagcgtccaagataacctaacgcagtagcgttcctaaattgcggcatttgccaaacccataaaataatttgaccgacaataaacagtgctaagaagatgtagaaaaactgttttttaccgattttacgccggacgattggccacaagaatacgaggaaaattcccggaattgaaccaatcaagttaattgaagccatccattctgggtgtccaacgttacattgcatatagaaaggccaaaccgtatttccaaaaaacataaacgtaaaaccaattaaaaagaacattcccaatacttgaagcggcttgttacgtttaatttcagcaaacaagtcggaatatttaacggcatcggtttcttcctgtgttggcaaaacccgttctttaaccccaaaataagtgcataatagtaacgcaaacccaataatcatgtaaattgccattacggaaaagtacgcgccgcccgcatgtggtgaagtgtaatcccccaaattcaatttaattccaaataatccgatatctttaagttgcttgtctggcaaagccagttggataaataacggtaagaacgtgtaaaccattaaattaccaatgttggcttcggtcatccgaaccgtagtcaaggcagaaacctcatcgttatcccgagttaacgatgcatttaacgcaccgtacgggatgttaacaaacgaatagattaaagccgttgccaagtacgatacaaacgcatagattacatttccccgcactgcttcaatcgggaaaaatagtaacgctgcacaaatcgtcagtggaatcccaaaatataggataaacggccggtacttgccttttttaaaatggctacggtcaactaccgctcccacccagggatcccaaaaaacgtttacccaccggacaatcaggaagatggttgctcccaccgtcgctgaaatgccaaataccgttgtcaggtaaaataacagcatcgagcccaccgtcccaaaaatcaggttttgggctaggtcaccggcaccgtaactcacccgctccttccaagataatttagcgaattcatctttcgccacgtcgttattactcgccatcttatcagcctcctaaaagctaaattgttttacagcatcattgtattcgcttacaaatcgctataatagaaggctttgtacccactttttgtcaaaatctgactattcaaaataacccgaatctttaagggaacgcactatccgcttctttcctaattgcttgcggtaatcccgtggagtttgtccactccattttttaaagcttttgctaaacattgatgaatttgtcactcctaccatttcagcaacatcttcaaccgaataatctaggtaactgagtaaaagtttagccttccgataacgctgcttttctacgtaatgaagcggcgtcatcccgtaaaccttcttgaacgttcggtaaccataaccatcactaattttgatttcattgcaaatatcttggaaggtattaaatttctccggattgccgatgttattttcaattaaaattgcaatctgacgggcaacctctgcttcccgttcggagaaccggttactgcaatgacccgggtggctttcgataaatttgctcaaatcatagaggtaattcagcataatcagctgaatcttgatgttgacttcatctttgcctaattctccctgttttcctagttcgctatatcgaacgatttctttggccgttttgagcgactcctgtgccaattttgacttagcataaatcaccgtattggccaaattacgaataatttctgactctaaccgaatattttcaaaactaaaatgaaaggtaatgtaagttaaatcgttaaattgattggcattccaatttttatgcaacgttcccggtgcaataataatgacgtctcctggaccatagctatacgaaacggattgattaatttcggtagtttgatatccatcgatcacacacatcaactcaaacgcctgatgtttttgttcaaaaaatgaccatcctccgggaaccgtccgcatgtgcccgccaaaaacgtataaacttgcgtcaacaactggaattgggataaatttctccattattttcactcccgtctggtaaaaattattttaaaaaagagcggaaacctgggtaaaacgcccctttctccgctccttattcgtggttatttggtctacttacaacatttcacgccggtaattcattaatccgtgactaatttctgccgtttgtccgtaaacttttttatacaggttatacagctcatcgtactttttaacgttttggacgttaggtaagtacgtctggtcgtacgcaacaaatttttcggcacattcatttaaggaatcaaaccatcccacacctacagcagcgatcattgctgcaccaagcccgggaccttgttcatttttcaaggtaaccacctttttattaaagatatctgcctgaatttgtagccatagggcacttttagcacccccgccgatggagacaaccgtatcaaaattactgcccttctccgcaaagatccgcatgatgtccctgaaggagaaaacaattccttctaatactgctctcgtgaagtcctctttgcgatgggtgccgtcgatcccgataaaacttccccggatgtcgccgtccgggtacggagtccgttccccaacgatgtacggcgtaaatagtaagccgttcgcacccacggtggattttttagccgcattaacaaaatcagtaaaactattgtcgttgctaaaccgtttcttaaaccagctcagactatatccggctgccaaggtaacccccatggtgtaatatttattaggaattgcgtggttaaagaaatgcaacgccccttggtaatcaactttcgcgttatcttcgtactttaaaactaccccagatgttccgattgaggatagcacttggttggtattaaggattcccgcaccaatcgcgccagccgcattatcagctgctccaccaaaaacctgagtgtccgtacttaattctgaaaacgatgcgtaggtttcgctaatttttcctgcaaacccgatcgattcaattaatggagggaaaatttccatcggtagttggaacgcttccgcaatttgggagctccatttccgtttttcttcgtccaacattaccgtgccagctgcgtcagaatattccatcgcaattttgccagtcatgcgataacgaacatagtctttgggtagcaggaacgtagctacttcctcaaaaatctggggttcgtgttctttgacccacaataatttcggcaaagtaaatccttcgagcggcacgttacgggtgatatcaataaagtcttttcccattacattcaaaatttctttgcattgttgagtagtccgcgtatcgttccataaaatcgccggacgtaaaacctgatgatgatcatctaggaggaccaatccgtgcatctgtcctgaataactaatccccttaatatccgttggcttaattttgtctacatcaattaaccgtttaattgccacggtcgtccccattacccagtcttccggattttgttcactaaatcccggctcaggctggcttaagggatattccttactttgttgggcgacaattttgcccgcttggtcaactgccgaaaccttaaccgcactggttcctaaatcaacccctaaaactacttgcatgatatccacctctcctgataataaaagggcggcccacgccaccctcttagtgtttaattaatgtttattttcctagcacagtgaacatgtagttattgatggttgctttcaactgttccagatggccggacttggttgcggcaattaattctgattgtggtttgtcaatgatatagttctcaaaatcagtaaagtcgactttgccattttcaaagtctgctccaatcccggacttgaacgaactataacggtcttcgataacggaatctaaaacgtggtcttcaagtaacttagcagctacccgcaaacctgcggcataggtgtccattccagcagtgtgtgccaagaataaatcttccatagtaaatgattgccgtcttggcttagcgtcgaagttcaagccaccagttggcaaaccgccgtttttaagcatttcatacataactaaggtagcttccattacatcgttagggaattcatcaatatcccagccaatcaatttatcacccatgttggcatctaaggaacctaacaatcctgcgtcacgagctactcgaacttcatgttcataagtatgacctgctagataagcgtggttaccttcaaggtttagcttaaagtctttatctaaaccatacgtcttcaagaaggcaatcgtggttgcggcatccgtatcgtattggtgtgaagttggttcctttggtttaggttccaataagaactggccggtgtagccgatttcattagcgtaatctttagccatccggaagaacttcgcaatgtgatcttgttccaacttcatatcagtatttaatagtgattcgtaaccttcacgaccgccccagaaaacgtagttacgtgagttcacacgtttagcgatttccaaagagtgtttaatttgggctgcggaatatgccaaaatgtcagcaaatggtgcggttgcgccaccagcaacgaaacgcgggttggtaaataagctagaagtattccaaagaactttcttacccgtttcttgcattttttcaacaatcttatccactaccttgtccaagttggcgttagtttcccgaagggtttcaccttccggagccaagtcccgatcatgaaacgcaaagtattcgatgttcatcttatctaagaagtcaaacatgtaatctaccttggccaaagcctgttccattggatctttaatgttgtcccatgggcgttgagccgttccatctccaaatgggtcaactaaacgttgatccattgtgtgccaatatgctacggagaacttcaaccactcgctcattttctttccatgaattacttcgtcaggattatagtagtgaaatccatttcctgcttttaaacctgcctggttacccacatattcaatttttttgcgatcaaataatgacatttgtacatccttctttcataaaatccagttggttttctcaaacaactaacctgcacaatcaatgtaaaccctttctttttaaattgcaagtattttttaaccaattgccttttttacttttctgataagatactagttgtatcatcgcttatttcggcttattcagccttctaagggcttttgagcgcctcttgaggtgtttttggggtaggaaaccgaacccggtgctacaatttttaaaaacaggagatatacaacatatggctaaatcaattaaccaagatgcgatgcgtgatttaaatcttaaattaatgcttcaatttctttttaatcacccgaaaacttcacgcattgaaattgcaaataatttaaagctaaataaatcgaccatttcgtccctatacgcgaccctgaaccggatgggttatgtgcgagaaattggacacggcgatagttctagaagcgggggacgacgcccaattctaattaaatttaatcgtcactatggttacaccgtgagtttcgaactcggacaccatcatttacggatgatgaccaactggttgaccggggagaagatttctttttattccatcccggtaatcgataaagatatttatgaaattgtcgaaatcatgaaggagcggattcgttcaatttcaattccaactgctgaacaccaattaatggggatttcagttgccattaacggcattgttgaccataaccaaatcattgattcgccctttatcgacatgcaaaatgtggacctagcacagacccttgcagaattccacgttccggtttttatcgaaaatgaagctaatctagcggccatcgccacccgagactacatgactgatcacaagtttaaaaacctaattgcactagatgtccacaatgggatcggtgctggaattattattaacgaccgcctttatcacggccaattagggcgggcaggtgaaattggtcgttccctatttttccctggctttgcttctagtccaacaatgaaaatcgaaaaattatatagtgaagatgcaatcattaaaaaatttgggcaattaaaacgaaccccctacgttgatcgtcagcagtttcttgaatactatcgggccgatgatcaggtagccattaaaatcatgaacgagttcaccgaagccgtggtctacctgcttttcaacgttagtcaaatcttcagccccgaactagttaatttacagtcgcgaattatcggcgaaatcccacaattaatgactaaaataattagggaatatgaagagctcgctggggctaattcgccaactaaactacagctttcgcagatgattgaagatgctccattatatggcggtgcatcgttgctaactcaccatctgttggggcttgagcactaccacctacagatgaaaatctaaattattcgaaaattattttttggaaccgcttgcattttttagaatatatgttttaattaatgtgtctacgatttacattagttttctcagacaactaactgccaatatatttaggaatgaggaataactaatgaaaaaagtatccgcaagtttcatatatttcttcggtgctttaggtggtttactgtttggttatgataccggggtaatctccggcgccatactattcattgaaaaacaaatgcacttggacgcctggcaacaaggctgggtcgttagtgccgttctcctaggcgccatgttaggttcggtaattattggaccatcttcagaccgctttggtcgtaagaagttactactattgtctgcaattattttcttcttaggttcaatcggctcagcttttgctgctgggttctggacgttaattttatcgcgaatcattttagggatggccgttggggcagcttccgcattaattccaacctatttagcggaattagcgccagcagaaaaacggggaaccgtctccagcctcttccaattaatggtaatgaccggaattttgatcgcctacattaccaactacacattctctgggatgtacactggttggcgctgaatgcttggttttgccgccatcccttccgcattgctcttccttggaggattagttttaccagaaagtccccgtttcttagttaaaacgggtgatactgaagaagctaagcatgttttgggtcaaatgaataaccataatcaaacgctagttgataaagaactcgtccaaattcaagaacaagctaaacttgaaaatggcggattaaaagaattatttagtcacttcgttcgaccagcgttaatcattgcgattggcttaaccattttccaacaggtaatgggatgtaatactgtactttactacgcaccaaccattttcactgacgctggatttggggttaacgctgctttaattgcgcatattggaattggaatctttaacgtaatcgttaccgccgtggcagtggcaattatggataaaattgatcgtcggaagatgcttttctggggtggtttctttatggggatttcgttgctagtgatgagttacggacttaaatattctcacagctcgtttactgcagcggtaattgccgtagtcgccatgaccgtttatattgcggtcttctctgcaacttggggacctgtaatgtgggtaatgatcggtgaaatcttcccgctaaatattcggggattaggaaattcgtttggtagttttgttaactggactgcgaatgcggtcgtttcgttaaccttcccatcattgctaaacatgtttggaaaaggcagcctctttattggttatgccgccctctgtttcttagcaatgtggtttgtttacgctaaagtatttgaaacccgtaatcgctcgctagaagatattgaagcagaattacggaagaacgacaaacgggttgaaggttaggagcaaaatcatgaaagtaaatattgatgattttgacgaataccaaggcaagtcggtaaaaaagattacgctagctaacgaccgtcaagtccaaatctcgctattatcgcaaggcgcatcgtggcacgaattcttagttcctagctcagctacttgcggtaacgacaatttaatcttaaattttgcccatactgctgactattatcaaaacccattttacttagggatgagtattggtcggacaggcgggcggattagtaaaggaagctttacgcaaggtgaacagctaattcaactgccgcaaaacgagggagcaaacactttacatggtggacctcgtggttttcatagttataactggagcttttatacccagaccaaaactgattccgcaagcgtaacgtttgaaaattctattaaagctgaaagtgacggttatcctggtgacttaaaggtggcgatcacctacacgttgaataatctcaatcaggtaattatccagtatcacggtcaggcattcgaccagcccgtgttattcaaccctactaaccacgtttattttaatttgacgggaaacgccaatattttagatcatgagctccagttaaatagccacgaacggttatcggttgatcagcaaaaattacctacgggagaattcaaggcaacggctggtactccgtttgacttcagccagtttaaacccttagctagctgtatcaacgacttacaagctactactgaaaaggggttggacgatgtctacgtagtcgacaatgaggtacctgctcccgcagcagtactccgtgcaccagcggctaatcgtcaagttgaaatttattctgcacgaaatggtctggtagttttcactgctaattcgttcaccgcggatatgcccctaacaaacggagccggacatccttatcaagggattgccttagaaacccaaacgctgccggacagcgttcaccatactaattttggtaatatagtgcttccggcacaccaagtagtggattatcagacggtttatcagtactcagaagtttaaatattccctttatttctaataaaataacttggtacattttgttaatgtgccaagccagaagcgttttatacgcattctacaaaaaagcggttagaaaggaccatctggttcttcctaaccgctttgcttattttctaaagtttgctgtcatcgaaaattggttcatgcaaggtttccacgtattgggccgctttgggggtcacgtaaagcaattggccttctttttggaaaagcttagtgtcaatcatcttttccattgctaaacgtaccgtaccctcgtcgaggtcttgttttgcatactttaactttaagtgttgcgtctttcccgcagcgttcaaaaattctaagtctagttgtttcatcaaatgatcctcccatttatttttatgcgatatataaatcaacgttccgattattttaatttaaagttacttgctctgtggtgacgacttgtgcttccgtcacttcatcttccaaaagcatttcgagtgcccgtgctaattcttccacttgtacagcgctgacgtctttatccacgttggcaaaggaacggcgcaccttcttatcgtgtcctgctccttccattgtgaagttgattcccgtctttaaccaagttttttgcatttcactgtcctcttttcttaaatattgaattagtaagtgtcgcgacgccttacatttactaataacaatcgagcagcaaaaaagtaaacctgttttctaaaatttttcactgttttttgcggttattgatacagtcaaatccgtcagttcgattaccgcataaaaataaaatcccgttaatcaaacagaaccccgttatttaaagaaaaacttatcgtattataataagaaaataattaataaaaacataaataaaatctattgacaacgtttttacaacacgctatattattagttgtacagagagcccgttccctgtactgagtgtttaagttatatcattttttcctgtagctgattcttctacccaaggagttggctacttcatctcctttttttactttctttcaataagacttcttcaaactgaagtcctgtctcatactgggacaacgctaaagaggttggtactatacataccaacctctttttattgatcaaagggatctaattaatgcaacgctaaaaaggctaggagcccccttgcaggagtttcccagccttcatttcgcgtgattaaggtaatttgttaaccaaatactttaaccccgtctaaatacgtcttgttcaagttcaattcgtggttaagtacgatgaagtcggcatcccgacctggtaaaatatgaccacattgatcgccaacgcccgcactatcggcagcattagctgaagccatggtaattgcctgttcaggtgtggctacattccaatccaccacgttcttaaccgcgtccttcagcaataaaatgctaccagccaaactattgctgccatccgttagccgggccgtcccgttggccactttaactgggaattctcccaaaatatagtcgccgtccggcattaagcccgccttcatacagtcggttaccaaagcaacgttttggtaagtcttggtttgcatcaagattttaacgacgtatgggttaacgtggtgcccatcgcaaattaattcatcggtcactccatctaaactcattgccgcgccggccatccctggctcgcggtgattaagtccactcattccattaaaggtatgggtaaacatcgtcgcacccgcctctacacaggctttggcttgatcaaaggtcgcatcgctgtgccctaaggcaaccaccacgccttcggaactaatcttagcagtaaattctaccgccccgtctcgttcaggagcaatcgaaattttccggatcatcccttgggcggcgctttgccaagcatgaaattcgtcaacactcggattttcaaaatactttggattttgggcacccttgtgtttttcggtgtagtaaggtccttcaaaatggatcccttgaaccttggcaccttcaaagtcgtccacgtggtcactaatcgtttggaccacctgcttcaattggtctgaactagcagttaaagtagtcggtagccacgaagttaccccgcattccaacaatcccttagacatggcgttgatcccttcagcatcggcatccatcacatcatgattcaacaaaccatggatgtgagtatcaaccaatccgggagctatccattgatcaccgtagtccacaattttgccggtaggcttttccttttggtaacgcccaaacttaccgtcaatcactggcaagtagccgcccatttcgacgttgctgcctaagaaaaattttgctgcgtgaatatagtattccaaaatatcgctcctaacctttaaattcgtggatggttacgcccttaactacccgattaactgttccagttgccgaaggagtgtccggggtgttattaactttaatcgatgacaatagcgcaaccgtttgtccaaacattacgtcagggaaggccatgtagccatctggaatttgatcgtttccgttagcaaaggtgaagtttgcaccggcaaaattattgtcagacttcactccaactcccatcactactggcgcaatttcgtctccagccacttcgtctaaaatgtcaacgtcgtattgacgagtgtaagcttcgttgctaacaaaatcaaagaggagggtcttttcattaacaaatgatttgggaccgtgacggaagcccatcgaagtatcgaagacggtagccttttgaccagccgtgagttccaaaacttttagttgggtttcgcgagtcaatccgccaagggctcccgaacctaggtaaacgattctttcaaaatcagtatcgacaatcttttgaatttcgtccacccgatcaattacttcatgccccatcttactaatggccttcacgtagctttccttttggtcgtccgtatgttttacatcaaagactaataacgcagtcagcaacatgcagctaaaactaccggtcatggcaaaacccttgtcgtttgagcgcgcgggttgcattaaaactaagttattttcgtcgctttgtgcgtgttgagccaatttaccttctggtgcgcaagtaatcgttaattggtaaaggtgacgaacgtacttttcagcaatatcaaccgttgcaacactttcaggactgtttccactccgggcaaaggaaactaacaaagtcggagtgtctttttcaaggtattgtttaggcgtcgacacaattttggttgtgtcaatcgcttcaaaacggaaacgtttccggtcgccattttcggttaggtatggcgccgccgtatccccaacgtaggccgaggaacccgcaccagtaaagatcacccggaccggttcgttgaattcgttttcaatcttttctaaaaattccgtaatggttgcttttgtagcttgatagttttgccaagcctcttcccacaattccggttcttgttgaatctcacgagtggtaatcaccgctcccatcttggttagctcatcatctgttttgttaaacataaagtaattctcctctcaatccttcagtgtcgatacttgatattgtaaacaaactggtcgccccgagcactgctaatggtgtactcgatgatttcgttcttatgattgtacgtcgttcgccgcgccaaaaatccggcagtattagaagcaacgttcagtagtttagcatcctcatcactgataatccccactgacaaacgctcgtcagcaacttttactttttcaccgtaatcctccaaaaagattgcgtacagtgaacgttgcttaagttctaaatcatcccgacttaaattaggaaacttagcctgcggaaggtaggttcggtcaatcataatcggctgcccgtctgctaaacgcaaacgtttcagcttaatcaaacaagtccccaccggaacctttagtttttgactaaagtactcgtccgcatcccgctggtacatttccaaaattcgagtctcgggcttgcgccccatcgacttcatttgctcggtaaaactatattcgtcgccaattttctgcgtgtaatcaatcatgttggctacgaaggttcccttgccgcgctgtcgataaatgtagccgatgttttctaattcagacaacgcttcccggaccgtattgcgactaaccgcatacttacgcatgatttcgcgctcagacaacagcttatcgtttggttgataattatttttgatttcttttcgcaaaacgtccacgagttgactgtacacgggacgtttttcgttatatttaaattccataaccattccgctctttctaaaccggtttcataatgacaatatgatacaccagattcaggaaagtcggatactaaaattgcaaattaagctgcttttccgattacacctagtgcagatagtacaactgccacgataattacgataaagattgccttggtagaagtcatccgtttcttaccgagcatccagtagattgcaccaacaattaatgcaggaactagcttcggcatgatcatgtcaatcttatcttggaagttaaccgtcatttttcctaagtgcgccacgagggtaacttgggtgttaaccatggtagctgctaaggcccccacaacgtaaacccctagaagggttgctgcgtcagtcaatgcgtttaattggccttgcatttcgttaaccaagctaaccccttgtttgtaagcaaacttcaattggatccaccggaaccacatgatgacgaagttaaccagcatccataagattgcgccaaaggcatttccttgaaccgccatattcgcggcaatcgcacccataattgcgggaacgagggctgcgaaaatcgagtccccaattgcggcgaacggacccattaaaccagccttgataccagcaacggtttcgagcgagtcgaccccttctttttcttccaaagccatatcgatcccttcgataatggtgttaaagaagttactggtgttgaagaattggttttgcatcttcatcatttttttaattcgggagtatggtcaccatacatcttccgcaattgcggcaagattaggtacaggtatgatgaaccttgcatccgttcgtagttccatccaacttggttgaaaagaatgttccggatgttcatttgtttgaagtctttatcgtttagtttataagttactttatttttagagttcgtcgtcatgaatctcaccatcctgttcatctaaatctgtcgcgttatcagctgacttcggtgctgcagcaaccatattttgttcctttaccgaacggttgtattgcattgctgcaagtgcaaatccaatcaaggcaattcccaacattggtaagtttgcaaatacggtagtgaacttagcattcatgcccgcaatggtcgttcccaaagtagaaatgttggtgtaaagagttgaaagcattgcagtaattacgaaacctaaaatgaggtatggccaatgtttcttaactggtaggtaacgaagcaagattgcgaaaccaactgctggaagtaatgcgccggcggttgccaaaccgttacttaaccatgaaaggttggtgttcatgtaatcaacggctgtctgtacgaacgggccaccaaatgcaagtgctaagaatactggaataccacgtgataacgtccatggaaggtaaccatagaggaagttccgttcaattcccttatagttttcttcgtcgatcatcttatcaattctgtgctggaagaaggtgttcgcaaaccgtgcgagaatatcggtttgaatcatcaaactagctaccggaacccctaaagctgctacggcaacttccgctttcattccggtaccaatcgcaaacgcggttgctaaaacagttccggagttagcgtcaatcttggaagcgccaccaaaagttccgacacctaaaacggttaattgtaaactaccaccgattaacaaaccagtttttaaatcgcccattactaaaccagcgacgatcccagcccaaattggttggctcaaactggtttgaacggtcaattcatccatgatttgccacattgaataaattgttaatataataacttgccaaattgcaatacctgaacccatgagaatccctccttatttaattagttttttggtttaaatttcttgagaatttccataaagtcgtttgcttggtcaccgggaaccatttgttgagtaagcttaattcccttttcgtgcaacgcgttgaatgcatccacgtcttcttgcacaacgttaatggagttagtcaattgggtagtttcgtcagtttgggacatgttacccacgttaacggcttcaagctttaccccatcattaactaaatctaacaagatttgtgggcgtttaaccacgatgaataccttttggaatcataaccgccccggttaatatggtcagccgccaccttttcaggaagcacacttaaatctactcctgccggacgcgctaattttaatcccgccttttcaatgtcactagctgcaacttgatcgtcaattaccataatccgtgtaacgcctaatttggtagtccacaagtttgcaacttggccgtgaattaaacgtccgtcaattcgtactgctgtaattgccatcctactcactccttcattttttaaaactccgttaataaaattactgtttctaagcccttgagtcggtacggaatggtcaacatcccgtttgaatccggtgaagcggtaacctccatactctgtaactgcgcaccttcgtggaagtagagcttccagtgttggttcgcctttgcgttagtaaggtgtaactgaatttgcgcttggtcatcgatcgtaaagtttgataaaaccatttggtcggcaacggccgttagtttcgtccctggcatctcaatgacgtaatccaagtccgtgatctgatttaaaatccgtttgaataatttctctttaattgaataatattgcgattcccaaccgtattttggatcagtgttcattggtaaaattagggtacgctggttcactaacgccatcgccggccctaatttcttggcgttttcgttgtacgcgtttgaaattatttgcaccggcgcagctggttcataatcaacttgatagtagtccccagtgtgctggagcattgttacccgcggattttgaattccgtcgatggtcatcccatcaatttgctcatacgattgataaccggttcgtgcttttttcagttccacttggttggcgcaaactaattcacctagcccccgatcaattaagatctggacgcttggaccatcaattaacaccacgttgttttcgagtaattcggtaatctgccggtcagttaaattgttgaagaactgtccgccaacggccagtacctcatccgtaaaatgactttgtaacgtccacttttcgggtttgcaagcaatccctaaagttcccaaaagttccaaccaagaatattcttggggtagtaattcttcagggttcttaccgactgcggttttaaggttaaagaccgcatccggagaaaagaggacctttactcctgctaaatggttttgcttcaggcgatgttgcatacctaaattcattaagggtttggattccgctaaaagacgcgcgtaatcatacgtttcgtcaatcccgttacccatcatgtcaaacaagttcaataaaatcccggaagcccccaccatttgagtgctttcgatttgcagttttgtaaacgctttatatttaacgaacggggaatacatataactttccaattcggggtaaatatcggaattttcgccaaccaattcggtggtaactcgggtaaatcgttcaaatgctcgcgaatatttcaagggagagatttcattatacgctggcaaatgcggacgacttactcgaggatgtccatcagcaaggttgtctaataaaccgtcccaatctcgtccttccacggcgtgccattccggaaacgagctcatcaaaccaagacgagtagctggagaaacttggtgaactgccgccgcgattttggcagccacccgtttcatttcagcacgcgctacgctaagataaacaattcgttcgggagtgggttcgccaggttgcaacatttttgcgacaaaagcttctcgactaatgggcttttccaacatctcgctgtaaagcgccatgtgtcggtcacaaaaacacgctaacttaattggcgtgtggttgtaatgacgaaaatcatcttctagccacaactctttaggctttagcttcgcatactccgcatagattgcggtgatataattcacccaacgatcatcttgcggacacgcaatcgaagctgaggcgtgccccaagtagtcgaccatcgtatcaaagccgagctctggggggacgcggtgaccccgatcactgtgcatcaaagtcgtccaaggatttagactggtcgtgatgcccattttcgccaaacgttccgcaactgacttaatcgttggcaaccaatgttcccgcacttgggcgagcgttggatgtccttggttaagttcttcagggttaatgaaaaataccacgttatcaatttgcccctgtttacaaaaatcaattaacttcgcttcttttacggtgtcccaattgtagggatcaatcgcaaatcttaatgaatattggtatgtttttgccattagctttatccattcaatttagcatttacgtcaacaacgccgttctgtgcctcactaatcaatgattgtttgtcaacatccattcccatcattacttggtttgcaaatccaatcaccattggtagatttaacccgctaaccacttctaaatctggatacttagccatcaagcgtaccacgacgtttgatggagttccgccgagcaaatcaaccgcaaccatggtcttgtcctgattagggttgtcattgataaactcttcggcagctttttgtaaatcttccggaccttggttaggttgtaaaccaatcgccttcatgttatcaatatggcctaaaatcatttctgcgcttttcagcgtttcgatcgccatatttccgtgactcatcaacagtaatctcataaaacgttcctccacatccttgaattttgtaaccgtttgctgtatccgcttacaaaattcagtaaaataaatggctgaattcctcagttccaattcatattatgactggttggtaccagtatgtcaaaccttatccaacccgggtaaaccttgatatcaaggcattttatgcggggaagagctttggtatagtccacgatttagcgaaattatcccgatattacggcttctgtcctctaaatcaaaaaaagcggttttaaaacgttttaccatcaattttttctttaaaagacaacaaaattcatcctaaaagtaaattaaattaggtgcatttaacatatattcgctcagtcgcgcgatgatttttaaatttaggagtttattttgacccaaaaaaatccgtaattactttttgtaaacgatttctttatgataggattagcattggaagggttttatatgttttgaacctaagacgtgcataatcaacaattaagaaggggagcaaatcaacatgaaattttccgtaactagtgaggcagcccagtggtttatcaaggaattggatttaaaaccaggtggcgcagtcaagatattcaccaaaatttacgggggaatcccaacggtttatccaagctttttcttagggattgcacccggaaataaagacgatgaatcaaccgccaagaccgtcgtagatgacatcaccttttatattgaatcgggaaacgaatggattgtcgacaatcacgacttgaccgtggaatataacggtcaggatgtcgactatcgtttttcagattaagtatgcgcaagcccatttttcggaccgctaatcgagctaaaaatgcttctcaagaatttcttaattccttgagaagcattttttaatcaatttattttgaaatattaaatcagctcttgcgtagttaagtctacgacaaacgggctgactgggtcaccaatttcattaaacagtgtcaaagtcggtgcattactatacccgtagcgagcttgggtagttcctagtggaaaatgaactctcaggtcagttcctttaatttctgccgggaccgcctgccatttttgctgaacatacccttcgattaaaggtggctgggtggcatgtaactccttaacataccaaaagtgaaaacaggtttgttccgcttctaagctcagccagcctagttgcggagttgcttgatagtcctttcccgctaagatacgacctattcgttggcccgccgccattttagccgtgggatggggattataatactcccccgtatccgcaattgaaatcaagtaagtatcggcaagtctttgtgccactttaagttgctgctggcggatttttgcccacgcgtgacgatttacgtccgcatattttggcagttgcactacgtataccggtaaagaaacgtccgccaaagttgcccgccaatcgttaattaaggtctgcaagagtcgatcgtaaatttcaggttgatctgcatcagtttcgccttggtaccagaccagctggctgaaccggaaatgccgaatctttcttaccattgcgttaaacagcgccccgggtcgcaaatagctgtccggcgtctttggcggcggccagggcgtctgccccacaatgttcagcgcttcgccaatcggaacctccggattgcttttcataaagttatacattaatcgattatgccgtttaacgttttggtgataacgttcgatgtctgccttaaagcccgcatccgtaatcttttcaatgtggcttaagaaaggctccaccacccgctttgccagtagcttgtctttgcgtaaagatgtttccgacacccaggttcctgctgaagcaccgtccctggtacaacaaacgatccctaccggcattttcgggtcttgtcgggccatttcttgggcagcgtaatagcccaccgccgaaacgtgtcccaggttagatttctttacttggtgccaatgggtggcacgggattgatattccttaacctccccatcttcgtaaacaaaagccggttgagggacgttgtaataggtgatgggagttgtgggaattgacgtttgggcttccgtaaaattttggtcttgcgacatgcgaaagcccacgttagactgtccggcaaccagtaaaacttgaccaaaccgaacgttttctaacttcaattgatgattttgaacttcaattttaacttcaaatgaagttcgataatcgataaaaggtcggaattgacaatcccacgtgccatcttttctaacaatcgcccgcgcaacttgggtaccgatggtggttttaaccgtcgctcctgcagtagctaatccactaatttgaaatggtttgccaaagggcagaatcatattatcagaaaatatttgatctacttgtaactgataatcctgcatgtaaaatcctcacttaactattttttagcaaggtaaagggcgctagcgttgttaccattgccgcgcccctccttgttatttaaattcaattgaatacgtgaatgtctgggtttcctgcggttctaggagattgttaccctttttattcttccagtcggtaggctcttcagcagcttgatccggcaagcccgcaaacggttcaatgcataaaaatggctccgcacggttctccattgtccataaggtaaggtatgggaagtctttgaagttcaatttaacttcatgcgcagtttgtgttgaacctaaagtgacgctatcaattttcttcgcatctaaaataattaaaccgtcgttaaacatttcatgatttaaagctaattcgctgtttttaatggcttcccaaggagctttctttccatcacggaatggtactgggttaacccctaaacgctgaatttgtttttggcgcggactaaaagttaaatggtagttttcaaaaataccgtcgttatctattggaacgttaaatgcgggatgtgagcctaaggcgtaaggcatccgccgttcgtcatgattaataacgtagtaagtagttaacagctggtgatcctttaactcgtattctacttgaagcgtaaaatcaaacggaaacattcgttttgtttgttcattggccttcaattctaattttgctgtcgtttcactttgcgaaaccttttgccaatcaaaatcccgggcaaagccatgttgcggcattgaatagatttgtccttccaatgcataactatcttggttagacttaccaattgctggaaacagaatcggggcatgacgttgccaagcttgaccattccaaatgtagtcgtatccactcggttggtcaatcacgtgcgtcagctgagcacccatgttatcaatttcgaccgttaagtagcggttcttcaatttaatcatctaatttacaccctttcttttggtttcctccactattagcatgattcattttcaagtaaatgtaaaggctttcttgattattaaatcaactattttaacgaatggttacctaatacctaacctttagaaatgcctgggaaactggtatgatagaaacgttggaaatttttccaccgatggcacttccccggtactccgggttcctttggtcatcgtcatttagtaactaattaagttataaaggagaatatttatgtcaactaaaatgaacgtccgtgagattgtaatatcagcaattgtagctgctctatacgtcgccattacctttgttttttcagcagttagtttcggcccgcttcaatttcgggttgctgagattttaaattgtttggtggtttatgatcgccgttatatttggggagtttctttgggagttttaatcgccaacctacaatcttctctaggaattattgacattacgtggggaactttaaccaccctcatcaccctgagcgttgtaatcatcgccatccggaaattaactgacaaccgggttaagttggcccttaccgttatcattacgaccattttaatgggcttcttggttgccttagaactcacctatattttaaaagttccctttttctacacttggggaacggttagtttaggtgaatttggggtaatgttcattggggcctttgtgatatacgctctaggaaaaagtattgatctttcacttaataaacgtagttaattaaaaaatttaggtaataaaaaacgaagggccctcggttcaggatccttcgttttttgttgttagattggtggggaagggcagagctaacgtagtcgaaacgggttctgtaacccaactccctccggctaaccaaattaaggcactaatcgcaaaaaacacgattaatgccttaatttttacaattctctgcagcatagaccaaacgagctccagccgccaatcttctccggttaatcaaatttggtcctcaatcgcttaaaccgctactaaggcctaaatccaattaatccttacttttccttgcagcgtagtcaaaacgggttctgtaacccaactccctccggctaaccaaattaaggcatcaatcgtaaaaaacacgattaatgccttaatcccgttagtcctcaggagctacccaggtttcagaaccctctacttaactaccaccttacccatcattttttggctttctaccaattggtgggccttctttatgttttctacgttcatcgggtggagttcctttgtcatcgttgactttaattttccttcatttaacaatttagcaatcttttctagattttcatgctgggacacgaggtcttccgttccataataggatttcgcaaacatccattcccacgcgaaagttacgcttttcctctttaaatcggttaagtttaccggctttttcgttgaagtaatcgaagcgattcgaccacctggcttaatcaattccaccattgcttcccactgtgcgtcaatgttatgcaattccaaaatgtaattcacgtgctgaacccctaaattacgaacttccgtaactaaatctttgcgatggttaaccgtttgatccgcaccgtgatccaaacaccactgaatcgtttctggacgcgatgccgaagcaatcacgcgtaaacctgccaaatgtgcaagctgcgttgccactgaacctacaccgcccgcgccattaatgatcaagagggcttttcccgcatttttctttgggtcctctggatcaatctgaagttgttcaaacaacgcttcccacgccgtcagggacgtaagcggcatggctgctgcatgaacatcatccatttgttggggagcgtgcccgacaattcgttcatcgaccaattgatactcgctatcactacccgctcgtttaaacgaaccagcataaaaaactcggtcgccattttcaaataaagtgacttcctcacctttggataccaccgtaccaaccgcatcaaaacctaatacccgcggttcttgcaacggttcggattgcccctttcgtactgctatatcgatagggtttactgaaacagcgctcaccttaaccaataaatcgtgcccgcttggttcaggacggtcagtggtaaactctaccaaactatccgcttcctcaattggtaacgattctttaaagccgattgcccacattttttcactcataaagctcagcctcctctttttaagtagaatatatgcttatttggtttaaaagtaaacaaattgttctgcctcaatctaaccactaaaaaaccgtcccccttcgccctactttgggctctgagaaacggtttaatcagattggtatttgtccccttaggacatttttagcttaactaaatgtgaattggcaaaccagcagccacttcagcagcatccatgatttcttcaccaagggttggatgtgggtgaatcgtcaattcgatatctcgaatggtgattccattttcaatcgctaaggttaattcagaaatcaagtctgatgcttctggaccaacaatttgggcaccaataatcgcaccagtagggttgtcagtaactaaacgaatgaaaccttccgtctggtccatcgtcattgcccgaccacttgcggcaaatgggaacttgctagatttagcatccagtttcttttccgcaaccgtttgtggggtttccccaaccgtcgctacttcgatattagtgtacgcaaccgcaggaatcacgtaatgcttgtcgtgtgcgtcttcaccgctcattgctgctgcagcaacttttgcttcatagctagctttatgagccaacgcaggtcccgctactacgtctccaattgcgtaaatgtgttttactgaagtttgcatagagtcgctaacttcaatcaaaccacgtttgtccagcttaacgtccgtattattcaggccgatttggtcggtgtttggccggcgtccaactgatactaggcagtaatctccggtaacttttttagtagttccgtcaacttcgtaagtaacgataacgtctttatcagtttggttagcttccactgcagtcgcttccgtgataatgtctacgccattcttcttgaagttgttcaaaactggttgaatcaactcgccatcgaaaccattcaaaatgtggtcaagaccttcaataatggtgatcttagaaccgaggttcatgtatgcgccagctaattctgcaccgattaccccaccaccaatgatgatgagatgttcgggaacgctcttcaagtttaatgcacctgtcgaatcaataacccgtccgctaaacttaaagtgtggaatttctactgggcgtgagccagttgcaatcaaggctttcttgaagcgatagatgtgcgaatcgtctccgtcaattacgttaaccgtttcgttatcgttgaagtacgcttctccacgcacaatttctaccttgtgcttctttaacaacatttcaactccaccagttagtttttcaactacttgatgttgtttccagtcttgagtttttgcaaaatcgagcttggattcacccacggtaaccccgaacggattgccgtgttgcaaagttgcgtataaatgtcccgcttgaatcaaagcttttgatgggatacaacccacgtttaagcaaattccgccaataaagtcgcgttccacaatgactactttttggcctaattcagctgcccgaattgcggcaacgtagccaccagggcctgaaccaataattaacgtatcaacatcgattgcttgtgtgccaacaaccatgactacacctccataagcatgtaggcagggttacctaagagtgccttcagctcgttcataattttttgtgctagagcaccgtcgattaaacggtggtcgaagctaagtgatagtttcaaggtattaccaactgctaattcaccatcttcgttaacaattggggtcttgcgaatgcggccaattccaagaattgagctttcacctgggttagtgattggggtaaagaagccgctgccgctttcagaaccaatgttagaaattgtaacggttccgccttgtaattcagcaggcttcaatttgccatcccggccccggattgccaagtcatcaatttcttgggcaacttgcataattgacttcgaagcagtgttcttaacgtttggtacgaaaagtccttgatcagtatctacagcgaagcccacgttagtttcttcgtagtagacgatttcttgggtttcgtcatcaattgttgcactcaattctgggtacttacgtgctgctgccgccaatgctttggcaacaaatggcatgtaagttagcttgtaacccttcgccttagtttgttccttgaattgatcacggagttccattaacttggatacttcaacttcgtccataatcgttacatgtggaacagtttgaacacgttgggttaagttccgtgaaattgccttacggattggtgaaagtggtactcgaccagccttaactggggctggttttgcaggggctggttttggagcttctgcggctggagcagcactaggagctggtgcggcattttcagcagcctttggagcagctggggcagcaccgccactaaagttcttcacgtctgccatggtaatgtgaccatgacgacccgttgcaggaacttgcattaagtcaatgtcgtgtttccgtgcgtattcacgaaccgaaggcattgccaaaacttggccattagaagccactgccgttccaactttagtaggttcatcattattagctggtgcggcattttccttagcaggagctgcacttgttgctggagcagcgtttccactaccagcaccgctaccgtcaccgttaaattcgatgagcggttcgccaaccttaaccacggttcccgcgtcaacgaataacttagtaacctttccagaatatggtgaaaggatttcttgcattaacttgtcgttttgtacttcggcaactggatcgtcttccttaacttcgtcgccaactttaactaaccagttcgcaatttcgccttctgccataccttcaccaatgtcgggcatgttgaagatttctgcatcgccgctaggggcattgtcgctgcccttgtcagctgctggagcagcatcggcagcattatccttgctgtcgtcaccaccgccagttccgtcgccatcaaattcgatgagcggttcgccaaccttaactacggttcccgcatctacaaatagtttagtaacctttccggaatatggtgaaaggatttcttgcaataatttatcattttgaacttcagccaccgcgtcgtcggctttgacatcatcgcctacttttaccaaccagttggcaatttcgccttctgccataccttcgccgatgtctggcattttaaatatttcagtcaaagtttacgacctccttgatcttatcaattacatcgtcttcttttggtaaccattcgttttcagctaacgcaaatgggtaaactgaatccggagcggctacccgaccaattggagcatctaaactcataatgaaacgttcactaatttcactcattaccattgctccaataccagcttgacgttgtgcttcttgagcaactaccacccgaccagtcttttcgatactcttgccaattgtgtcaaggtcgagtgggcttacggtccgtaggtcgattacttcaacgtcaatgccttctttagcaaggtcttctgcagccgctagactggtgtgtaccatgccgccataggtaacaacggtaacgtctttaccttcacgtactacgtttgctttatcgagaggagtggtgtagtaaccttctggaacttcgccacgaattgaacggtacaaacgtaagttttcgaggaagattaccggatcgtcactttcaattgaagaaagcaataatcccttcgcatctgctggggttgccggcataactactcgtaatccaggagtctgtgccattaatccttctagagaatccgcatgcatttcaggggtcttagttcctccaccgtatggcgagcgaactacgattgggaatttacgagtgccgtggaaacggaaccgtccccgagccatttgtccagcaatggagtccattacttcgtaaacgaacccgaagaattggatttccatgatgggacggtaatcttgggtggtcaatccaattgctaaaccaccaattccactttctgctaatggagtgttgaatactcgatcttcaccgtacttttcttgaagaccatcggtagctctaaatacaccaccatttttaccaacatcttcaccaaaaattataacgttttcatcattagcaagcgccaagtcttgagcttctgtaatcgcttggatatatgtttttttagccatgattacttgccctcccctctaaatttgttgatctgatcttgcgctgcttgtcccggaacttctaaggtttgttcaatgaagtctgagatcttttgcttagcaatgccatcagcttgtttaactgcgtcatcaatttgtgagttaacaatgtctgcccagtcgttttcaatgtcttctgaccataagtcacgatcagtaaggtacttacggaaacgaatcaatggttcacgcttagtccagttatcaatgtcttcttgagtccggtaacggagtggatcatcacctgacattgagtgcggtcctaaacggttagtgatggtttcaatgaagactggtccattgccatctacagcccacttacgagcttctttagctgcaaggtacatcgcaattgggtccattccatcaactacgaaacttggcaaaccagctgcccagcctttagctgcaaggtgtggtgctttagtttgtacgctacgtggggtggagattgcgtatccattattttgtgcgaagaaaactgctggagcgtggtaagcgccggcaaagttcattccttcatagaagtcaccttgtgaagtaccaccatcaccagtatatgcgtaagcaacgtttggtttattacgtttcttcaaacctaaagctgcgccggctgcttcaacatattgggcaccaataatgatttgtggaaaccatccgttaacgtcttcgaattcgttaccttcgaaatgaccccgagaccacaagaatgctttataaattggccagcccttcataatcagttgtggaatgtcacggtaaccagggaataaccagtcacccttttcaaaggcatagtttgaagcgatttgggaagcttcttcaccaatggttggtgcatagaaacctaaccgtccttgtttggataattttgatgaacgttcgtgcaagatccggctgaataccatttgcttcatgagttcaaccatttggtcatcacttaatcccgctctcttaagggcgtcttcatctacgatttcgccatcgttgttcaagacttggagcattggaaagctttggtcttgatcttccatttgaaggtcgaaatctaaaatctttttattgtcatcttttatagccataactacccctcctaggcttcaaataattgtgttaattcatcgacgctgatggtaccaaagtactgctgatcctgatttttctcaaagaccggtctgatttgatccgcttcaaacggcaaaccaatgaactgatctttgatgtcccgccagtcacgcagcatcaagaaatctccggtaaagttaatatcttgaatgacaccaccctcaacttgaacctggacttcaatgatcccgccatcgtacttcgcgtgattcttaaaattaaagttcggcgattgaccatagttccagtcccaagttgagaattgatctgcagtcaaccgaataatttcttgtttttgctcaggagtcaacagaatctcggaatcgcgtccgtgatcggtcagctcgtattgcacggcttcccagaagtcttgcaaagtcaacccttctggtgcggcttccttaatcattccgacacggctgcgtactgacttagcagctttcgaaataaatttttcatccgccacgttcagtgcccgcaccatcgtgtcgacgttgctatcgaatagtaacgttccgtggtgcattaagtagccctttgcataacgctgggccacgcctgaaatcttcttgccattaactactaagtcgttgcgtcccgtagcttctgctggaattcccaagttatgtaacgccttcaaaactggttcagaaaattgcttaaagtccgtattagctgatgaatccagtggtacaaataatgtaaagtttagattacctaaatcgtgataaactgccccacctccagtaactcgccgaacaacttcaatttgatgttgatcgataaattcttggttaacttcaccaaatgtattttggttttttcctacaatgacagcattattattttgccaaagcgcgaatattggttcatctgcatgaaggttattcaagatccatgtatcagttgcgatattcgtgtaagcatctgtccccaaatatgtgacatagcgcacaatgtaaaccccctcgcgtcgcctttgtaagcggtttctgttacaaccccataataacacacatttgctattttgtggacgatttttcagaattaaagtgtttaaatagcagggtttgttccatgaattcaactttttatggtgtacaaatatagattggtatatacactattgcgataaaaaagacctaggattcactaactcaatcctaggtcgagggtcttaatcgcggttttcttctgcttgaattcttgccacttgttcactgattttcaagaatggtaggtataagaaaacgccaataataatcacaattaattgcaggataaccgaacgccaatctccggcagtcgataaataaggaccgattaacggtggagtagtccaaggaactaacacgaccgtccggcttacccaaccccacaaagttgcaaagtatccaatcaaactaccaatggtggggaacaacacgaacggaacgatcattggaaggttgaaaacgattggaaatccaaagatcatcggttcgttgatgttaaaaatcccgggtgccaacgacaatccggcaatttgccgcgatgatttcactttactgaaaattagaattgcaataatcaatgcaatggtgcttcccgaaccaccgactaaagtatagttgctaacaaaagaagtggtgatgatgttgggaatctcttgatgatgcgcataagccgtcatgttttcgttcatattaaccaacaccaacggatccaataaggttcctgagagaacggtttggtgaattcctaaaccaaacaggaagttagctaaggtgtagattacacaatatccgacaatgctggtgttaaagccccgcaatggttcttgaatccaagttttaattaaattaattaggtcagcattgaaaaatccagctagcagtgcagcaataattgcaaaaaatgacatcaataagattgctggaagtaaaacactgaatgacgccgctactgctgggggcacgttttcgcctaaatgaatctggagccgtttaactgacgctagattaatgaaaattcccgttgcaattaaaccaacgaaaattccgccaaacattccttgggtcccggtatttaagtaactcaacccaccggtaacggttgccattttcgcaccgcccgacgctaccgtccccagttgaatgctgttcggcattaggataaaaatgctggctaacgacatggctgccgcagcaattggattattgaaacctttatttttagccagcatatagccaatcatcggagcaactaaaattccagctacgtttaaagttccgttagcaatcgcgttaccggcaacttggaacttcgctagcaggtctcccttcaaaaaccaagtaaacactacgttgtttagcaaaactccgatgccggccacgataaacattggcagaatgactgcgaaagcatcccgcaaggaccgtaagtaaacccaattgccgacctttaccgaaatttccgtaaatttggcaatgaactttgaattctgcattcgatcattaattgatccgcttttcgaatcgcccataaaaatccctcccgttaaaaatttctaatctaaatcagcaccattagacttaataacttttgcaaaccagtagtaactctttttaggcacgcgtttaaggtcgcggagctcgtgattgccccggttaacgtagaccattccgtaacgtttttccatattgcctgccgagcttggaatgtcgatcagtccccatcccagataccctagcaccgctactccatcgtcatttaccgccgccattagcgctcgtaaatgatcacgatggtaggcaattcggtaatcgtcttgaataggctgcccgtgaaattcttcccgatgcccgattccattttcaatcggaaacatcggaatcccgtaggcgttataagtcttcgtcaaaacgtcgcggaagcctagcgggtcgatattccagccccattccgttgctgtgagatggggatttgctaccgcgccgtaatctaagtaccggttgggcatggtgcctgctggaattttggtggcatccaccacgttacttgcgtagtagctgaaggcaatgaagtcgctctttaatttggcgaattcttgccggtcttgatccgtaaaatcaatatcgaaatggtgccgttcaatataggtggatacttccgttgaatagtggccattaacccaaacgtccaataaattgcgattcaaatattcatcaatttgtcgcgcagcaaaggcgtcttccggcaagctgctgtttgggtaagtctccacgaacgccagcattccgccaattttagcatcactgtgtacgtgcaggtaatttgcaacctgaacatgagccgtcattacgtgatgcgcaatcctttgcaattcttcatcggtgcggtcgccatttaaataaccagcaatccgaaaggcctccgtttgtgaatataggttctgctcattaaacgtaatccataacttaacccggtcgctgaaccggtcaaccatttccttaccaaaacgaacaaaagcatccaccacgtggcgactcaaaaaaccgttatattgttttgccaagtgcaacggcatgtcaaaatgatacagacagatcatcggctgaatgccccgttttaacaacgcgttgattaaattatcataatagcgaatcccctcttcattgaattctccgtcgccttgcggatttacccggctccaagaaatctgaaaacgatagcagttcatcccctgctgagccatcaaatccaaatcttcttcataatgatggtaattatcaattgccacgtcccaatccgaagtttctgcggttgctttatacgtgtcgtaaacggacggtcccttaccgccctcatgtgcacctccttccgtctgcatactggatgttgaatttccccataaaaaatcatcgggtaactttgcttgcacaattatgaccacctttcttttgtatccgttttcattataatcaccatttttataaaagtaaattcttttattataaaagtatatacttttatcaatttgtgaataccattaagatgggctaaaattaacggtgattaaggatggtgtcagataaatgtataaatacgagaaaatttcgcaaactttgcgtaaaaaaattatgaaccacgaattgcagccgggagtcatgttgccagaccaaaatcaattggcaaaagaatttgacaccacccgcatcacgattagcaaagcaattcagattttaatcattgaaggactagtttatagtaaacgcggggcggggacgttcgttcgaaaagacgtgcaatttaacaatgatttcaatacagacgttgacaagccgttgggaacgaccatgacccaccctaataaaaaggtcactagcaaacacattcatttaaccgcccggatcgctaccaaggatgagcaggaacatttactgctggaaaacggggaaaccgtctacgtaattaagcgaacccgattgattgatggcaaaccgttcagctacgaacaaacgattatgccaactaaaattgcgaccatcactaaggaaattcttcaaaaatcggtttacgaatatttacaaaaagagcaccatttagagtttgccggatcccatcgccaaatcatggctcgtaaggtttcggatgaagacgttcattttctaggagaaaagaagggggaccccattttagtaattagtcaggtcaactatttagttgacggcaccccttttgaatactccgaatcacattttccgtaccaaaacagcgtagtgtcggcggatataaaattagaacactaataagttttagggccgcgcaactttgcctttgtagcaaatttttgtttagaaccaaaaatgggagctttcagatcaaaattctgaaagctcccatttttaatattctattgttgcgatgaattcgttgattcactttgtccattaacaatgttttgaaaaccgctaattaattgcgcattttccgttaccttaaagttaactccgtcgctagctgcttgagaggtaactaacacttctggagtttgttggtggaaagtgaacaagtacaggtattgggtgccggcataagctgcgaccactcgataatcgctgtcgtcttttttattagtcgtccatttcatcgtcaccggttgttggtttacgtaaaccgtccccgtcgacaaataatcgggaagcgtgacgccttggaaggttaccgagctacctgaattagttccggtatacgattgccccatcgtctgttgccaatcactaatgaacgccgccaattttgcatcctgtttctttgtccaaagcttatctttgcttgatttatgtttatgtttttttgtcgttgcctttttagcggacgacgagccttcttcaacgtcaatcaccttagtgctactagattgccgtgccgtggtgtgttcaggttccacgtggttaggatagaaaaatttatatccgcctaaaatgaccaatagtgccacaatgacccacacaaccggattgaccggccaacgggagccctttttcatgtgtttcatctaatcacctcatttccatttattatacaggaagctagcctttcgtgggagaccacgcctaaaatactctttaaattggtgctatgtatacaaaaaaaaggggtcggaaaattccgacccctctctgtgattaaattatctttcaacttcttgaagcttttggttgtcatctaattgcgacttgttttccaaatgatgcttttgcaattgattcatactgaaccatagcaatgccaaagcaatcactgcaaacaagagcaacgcgcccattgcttgttcaaaggtaccgtcgccgagaccagacgtaattgcctgacggaacgataagattgagtaagtcaatggcaagaacggatgaattacgttgtagaagtggttagttacttccattgggaaggtaccacctgatccacctaattgaagcatcaggagaatcatcgctacaaaccgtcctgggttgtcgaaggccatcgacaagaacatgacgatgtacatcgacgctaacgaaatcataatcgcggtcatgtagaattgaccaacgtgatctacgtgaataccagcaatcatcatgattgtggtttcaaccaacgccattcctagagcgactaccgtaccaacggaaaccttactcaagaaccattgggttggagtaccaccgcgttcggaaaccttccgaattgggtaagcaaagttgaagacgattgccccaacgtaaagtgctagtgaaagtacgtatggtgctaacgcatgtccgtagtttggtacgtaactgtagttagtgtgtttcatcttcgttggtgctgcaaacatttcggccgtcttgttggtaagcggcacgctgttaacttgttttgcaccatcagctaacttgcttgataattcgccattgccggcgctaatttgcttagtagcgtctaacaaggcacctgagttagcgtctagttcagcagctccagtgttcaactggttaacaccgtcgatcaacgttccggtactgctgttaagagtttggataccagtgttcaattggtgaccaccattatcaagttgcgcaacgccagaaactaacgctggcacttgaccatttaaggtgttcaaaccgccagtaacttgagaagaaccggctgccaattggttaccaccgttagcaagtaggctaacgccgcttactaaggttggcatttgtgaacctgcggcactaataccgttgcttaattggttaattccaccagctaaagcacctgtaccagcactgatttggttgctaccagcagctaactgaccaatcttggattggagagttggggtttgcttgtctagcattgccaagcttgagctcaattcttgagaaccgctaaccagtttcttaacgtccttcgaattcttgttagtttgacttgcaaggctcttagcaccactatctaattgagcaactcccttagtcaaatcagaagctgaaccggcaaattcgccgactttaccagctaccgtgtttgaaccggatgaaagagcttgtaagttagttgtgacttcttgtgaaccagcagctaatttcttcaaagttgctgccagttgtttcatgtcatcactgttgccagttaattcgtttgcgccagctgccaacttctggaaggaagctgttaacgacgtcacttgcttattgatttcagcttgtttgttagctaaatcattcaacttcgttacttgaccttgaacgtcagtaatcttcttttgaattgatgcaatcttatttgtatctacagtttgcgaagtagtcttattttggctaccgttagctacgccagctaaggcattcttcgctttagctgcatcttctgcacttaatcctgcaccgtcaattttagaattaatggttgcttgagaaacgccaccgctagtgcttgtcgtagttttacttgagtttgccaagcttcctacttcagacttaatttctgaaagttgattattgatggattgtgcggcattgccaccatttgtttgtccagcagttgccttattcaacgcaactaattgtgtttgaatagaagccatttgttgcttcaaagcagccgcttgtttactaatgtcctttgcacttacttgatcagcaacttggccaagcccagttgagatcttgccgttagcatcggctaattgtttggaactcttcgcaatgtctgcaattccgttgtgcaaagcgttgatgctatttggcatatccttagtatcgttagctaatttagctacgccaccttgtaattggcctgcaccagccgatacaccgtctgtatattgcttaactccagcacttaaagcacccgcaccacttgacaattgcttgatgccgccaactaattgaccagtttttgcgttaagttcttgtacgccatcgttaagttggtaaaccccgttgacgtattggggaaccttaaccttcaactgtaaagcaccgttgtttagttgtgaaactccggtaacgagcgcaccgctcttttgttgcaactcgttcaatcccttactcaaggcaaccgcaccggtggttacttgaccagaaccatttgccaattgggaaactcctgaagataatgctccagtttttccgttcaattgatctaaaccattggtcaattggctagaaccatctgctaattgagcaacgcccgcttgcaatggtttaactgaaacggccattgtagcaatcccgtcgtgtagttgggaaactcctgccgtgtaagtcttggtaccgtcatttaattgaaccgcaccatccttaagtttcttagctccgtcagaagcttgcttgaaaccttttccggcagtcttaacttggtcaaacattgccgtagcataggacttcgtaacttgttcccgcacttcggaattaagcttttcagtacccacgtcactgataactttaccaatgtagttcaacgaagcgttcgttgaatacttcagttgcatcttcttaggatttttatccgtaaccgttgccgcgttagctgagaagtcctttgggatcgtaactaccgtgtagtacttcttatccttcattccttctttagcctttttagccgatacaaagtgccatcccaattgatggttgtgctttaagttatcgaccatttcatcaccgaccgcaagtcgttggccttggtacttaacgggttgatctaagttaacgactgcgactggtaaatttttcgtatccccatatggatcccataccgatttcaagaagaaaatactatataggaaaggaatgaaaataattgccagcacggagattaaaattaacttattatttctaataaatttccactctttgcgaaccatgcttttccccttctcaacaataattttttaatattcgatccaatgaatgaacaatcagactatcctgacttaattaaataacttcttatcgttccgcaaaatatcaaccaacttttgcacttgatcgagagcctgtccgatcgttaattgatagatgttgctagtacctttttttctaaccgaaactaactttaaatcttttaattgctttaaatgatgcgatactgcgggctgggaaagaccaataatcttcgtcaattccccaaccgttaagcctttttcactttcccctaaagtaatcataatttgctggcgccgctcgtcggaaagcgcgtctagcaaggggatattcttcttaaaagctgcgagtgccttgctatgctccaccatcaggttgtcctccattcaaacattcgaatatttaaatacaggaggtattttaccgcgaattatattttaattcaacctttaagttcaattcaatttttcttcaattttagttgttctaaaataccattggccttccttaaagccgtggtagaattaacttaattacgagaacaacgaggtcatattttgaataaaatcgaattaaccagtcaatttatccaacaacatttaaatcaatttcagtgccccgtttgccaaggtgcatttatatccgcggaaaccggtaccgtcgtttgcgaaaatcaacacacttttaacgtagctaaaaaaggaagcctctttttccttaaccatcccgtcaaaaccgaatatactgacgaaatgctgcgttatcgccaccaatttttaacggccggctttttcgacccgatgctcgctcgggttcaagaagcacttgccggtggccttattctagatgccggctgtggcgaaggcaccaccaccaaatggcttgccaaccactcgaagggaagtttagtcggcctggatatttccaaaccagctattaacattgctagtgcaggggtggcactggaaaatcaaccgctcttcatggtgggtgacttagcgcgtttgccgtttgccgaccatcgtttagacgccatcgtcaacattttgtcgcccgctaattaccaagagtttgaccgcgccttagccccagacggcatactggttaaggtcattcccggcaaccactatctgcaagagctgcgccacctggtttaccccgatggacaacacgctacctatgataatgctccggtaaagaaccactttatcgagcgctatccgcaggcagaattcattaccgttaagtatgaatttgcgcttgaccaaccactttttacggcgttgttcaacatgacacccttaacttggcaggcgcaagaaaatcgggaacagctcctccaacgaccattagattccattaccgcagaatttgaaattgccgtggtgcgccgttcttaatcgcttgattaggctagattaatataggaaaaaattggattgttggtgcatactaacagaaaatcggcagttatgcttggatcaagcataactgtcgattttaatttgaatagcacaaactccccgcccccttttttacttggtgggcgacttatcaatccaccgttcgcaaatgaaatccaaaattgcgaataccaccagcgctcctaaaaattggcgaccttcgtgagccctcataaaatcaatttcactaacaaaaaacatggttatgatggtgcatcccaatgctatccagtcgccacgcgtaacgtacttacgtaagtatcgcatcatccagccctcccttccacatcttgcggtgttcagcgttataaacctactcaaattatactctttacgcggtgttaaatacatctcgtaaactattttttcggcggttcaccacctaccaaaaaacagcctcaaccaggcactccccgttgaaactgttcctaattttaaacattacttccttgataccggcgccaaaggcaatccgaccaccaagggatcgttatttctcaattactaactatttgtaaataaaacttcactttttgtcaaccgcgtggccgccaaattcattccggagggcagccactaccttaccagtaaaggtatcgtcttgcatcgaacggtagcgctccgcaaccgccgcgtaaataaccggtgtaggaacgtgccgatccatggcttcttccaccgtccattgaccttccccattagagtgcatccgtcccgcaatttcagctaggtgcggatccttactgaaagcgtcctgagcaagttcaatcaaccaactccgaactaccgagccgtggttccacagtttagcgaccgcttcgttgtcgtaatcaaactgggaagcttccaaaacttcaaaaccttccccaattgcggccatcattccgtactcaatgccgttgtgaaccattttaagatagtgtcctgaaccagccttaccagtgtagagataaccatcttcttgggaaatatcttcaaataatgggcggatggtttcaaaggctgcggcgtcatcgcccccaatcatgaaattcccgccattaagtgctccgcgccaaccgcctgacgaaccggcatcaaaataatggattcctttttccgaaattagccggttatgccgcaaactatccttccagaaggtgtttccgccgtcgattaagtaatctcccgcctctagcaggtcgcctagctgcgcaattgttacatcggtcggcttgcccgccggcaccattacccaaaccactcggggagccgtcattttttgcaccatttcagctaacgaagccgctccggttgctccataaccgatcgctttttcaactaacgcgttattcaaatcaaatccgaccactttatgctggtgacgcaacatgttttgggctaaattaatgcccatttttcccaaaccaactaatccgatttccattatcgataccccgcttaatatttgattaaattgcaaatgttcacgtgaaaccttacaattaaattatagcacggtccctgttttgtacaaccgttttcatgaattattattaattctcatttttgttgtataattggagctgctacgcttgagtaatttaaaaggagcatcctatgacaaataattcttcaaaacggaccacgattattgatattgccagtcaccttggtatttcgcacaccaccgtttcccgggcgttaaacgggagtcccaaggtgaaggaaactacccgacggaaaattgtggaggctgcccatcaactaggctacgttcccaaccaaaacgcgcgcgggcttaaccaaggacggacctacacgatcggcctgttttttaccgatttacaaaacgggacttcagggctctttttaactagtattattttaaatattcgtgaacagttacccgaaaattacgtcctttcaatcaattccattaacgaccacgaccgccttagctttttcgacggcgtcgtggtggtcagtcaatccgtgaaggacgaagagttcatcaataatttagttcaaatgaaaattcccgtcgtggtgctcaaccgtaaaacgcaaattcagcccgtttataactattggctggacaattattcggcggcccgcgaaatgactacccacgcactacaagctgggcaccgtaatgtagccttaattcgtggctccctggattacgcttcgacgcaggaacgttcgcagggttactttgccgcaattcaagaatgggacgcagctcacccaaccaagttattcgctcatcccccaatcgagggtgaatatacggctaagggtggttgccgagcaatggaagaactgttggcacggcctaactttccggattacgttttcatcgaaaatgacgacatggcaatcggggcccttcacgcgatcaacgcgcaccctaatctaaaacattcggtcagtgtttccggatttgatgacatggacattgccacctacacttcgccatccttaactaccgtacatagcccaatcaccgaaatgaccgcgttagggattgcgactttgaaacatttactaactaatgacgaactcgacgacgacatcccgtttaaaaaatgctttaaaatgccgattatttaccgggaatcgttgcgtaaataaaattaaaaatgctgcctggttaaggccggttggcggcattttttgtttcttccggttaaccaaatcaagggaaccaatcgcaaagttcgcgattaattcccttgattccgttaatcctcggaaactacccggggatgaaagcactctaatgcgttctctgatactccgctatactatcgtattcacctgccaactctctcgacagcctaatatagattggcatcaggtcacggtacgccctaaaatttgctgggtttggttcatacgtatttaccgcatcctttaccaaaaagtcctcgaccttcgtcaaatcctttgccaaacctaagctgatttgggcgattaccatcgcgcccatgcagcccccctcaactgacttagggaccttcaccggttcctcaaatacgtcggctaaaatatgcttccataattctgaatgcgcaaagccgccggtcgccaaaatttgtcggtcacctttcggcatgacttcttccaacgccaagttaaccgtgaacaagttgtaaacaattccttccaaaatggcccgcaacatgtgcgctcgcgtatgggtctgcgtcaatccaaagaaggatccccgcgcatttccagaccaaatcggggcccgttcaccacctaggaaaggatggaatagcaagcctttagatccggctggtgcctcacccgcaatcttagtcaacaggtcgtacggatcttggttgaggagctccgcggtacttttttcggcgttgaaaaactggtcgcgagcccagcgaagcactactccaccattattaatcggtccgccaataatccatttgcccggcaaaactggataacagtaaatccggcctttcggatcaaattggggctcgtccaccatggtccgtaccgcggccgaagttccaatatcaatcgcaatttgccccttccgaaccgcgccaaccccaatggtggtcgccacgccatccgaagatcccattacaaacggagtttccgcagggattccaatttgttttgctaattgcggatttaaaccgtggacctgatgcgtggcttccaccacttgtggtaattgggaggcttgcaatcctagttgttgcaaagctgccacgtcccactgcatttcccgggtgttaaataatcccgtggccgccgccatcggttgttcttccaaaaattggccaaagtatttccaaataatgtacgatttaattcctagccagtacttagcttgtttaaaccgtgcgggtgcttcatgtttataccattgtaatttgtagtaaggcgccatgggatgggtgggcacgcccgtccgttggtacagtgccagtcccgaaccgtcccgtttggcttggtcggcatacttttcagcccggttatccgcccaaattgcgagtttagtcaccgggttaaattcgtcatcaacccccatgatggaatgttgctgtgcacttaacgaaattgccaaaagctgatcttgcgcggcgtcaaaatgggcggtttggataacctgctgtaaaacggccaccgtcgcgtcgtaaatcacgtccggatcttcctcggcggagtccacattttcgcgaatgattggataaagttggtgggcaacttgcacaatccgaccctttaggtcaaacagtaccgccttcgtactggtggttccaatatccattccaatgatatatttcatgattaatactacccttcgattaaagttttgccgttaattcccgtaccaatggacgttcgttaacgatgttttgcacatcggatacacatttttcacccattccatgcaagcattcgtaagtgtaagcagaggtgtgcggcgtaatcaaaaagtgttcgttcttcaagaacggatgatccgcccgcactggttcaacttccatggtgtcggctgcgtaaccaccaacttggcccgcttctaccgcggctaacatggcattttcgtcaatcagcgcaccccgcgcgtggttaacaaagtaaacgccctttttgaccttctttaaagcggttgcgtcaattaggtgataatcgtcatcgtttaaggaggcgttcaacgaaatgtagtcggcccgttccaaaagttcatccaggctcaccctttgcacgttattgttttctagccaaccttcgggagccttcgggtcggggtcgttaattaaaacgggcccgccaaaaattccaaatagttccgctacccggctgccaatatttccggcgccaattaccccgaaagttttgccggagaattgattacccataaaacgggcccggtcttcataatggtcggccttaattgcatccccagccggaaccgtctgccggaccagcgccatcagatttgccaacacattttccgcaacggcatttctttctactaacggtgaaacgatggtgaccttcgtgccgtgcgccttcgctgctgctaggtcaacgttgttatagccaattccatggcgtgaaattaacaatagctcatccttattgtcaaagaattcctgattgaaattcggggttacgctggctaccaccacgttgaaaccctgtagcttttctgccaatgatttaccatcgatatccgtcggcagcataaaccgcttaacttccccaatctcttcgagagcttgccaatgttctttgaaaacttgtccaaaactacttgagttgacgaccgcaatccgatattttgtcatttctcattctcctctgtttagtttgcttgatttaatttttgatggagggtttgtgcaaccgcacccggtccctgcagcatttccgctaggtcggcttcaattagttctgccaaaccagcttctaccaggtccacgccgaatagcttctggttagccaaaatcggtttgatttgggcttggaggtttgcattttcacctagttgaattccctgaagctgttcttttaggtagtccattaacggatctggactaggttcaaacgcctgccccttatcatcaatcgctaatagataacgcaaccatgcggcaatcgttaacgggataaatttcaagtcggtaaccttcaacgttggatctgccaaatagtgttgaatagttacgccatagcgcaccgccattttttgcgatgtgtcagtcgcaatacgttgcggagtgtcgggaatgtatggattaggcagccgtttttcaaccacttcgtcaatgaaggctttcgggttaattaccttcggatccttcaccactggtaaaccttccacgtaaccaatttgcttaattaagtccaccaaatcggcattcttcatttcttcggaaatcgagtgataatccagcaacgagccaaaaattgctaaagccgtgtgcaacgggttcaagcaggttgtaaccttcatttcatcgacatcgttaaccgtcgtccggtccgtcacgattaccccagccttttcgagtgctggacggccgtttggaaaggcgtcttcgactaccaagtaatgggcttcttccgtgttagcaaaggaagctagcattgcgccgtacgaagctttaaacggggtcatattttccacgccctgggcctctaagctttcccctactgctttggcagggttcggagtgatccgatcgatcatggataatgggaaactaaccttgtccgggttttgcaaataatctaagaattcgtcttcgaccaactgatttgccgcccagcctttagcaatcgttaagatcgactttttcaaccggtccccgttttgggaaaagttgtcggtacttagtaatgccaacggtagctggccgtgattgaaacggtcgtaaagtaaactagtaaggcgggcaatgttatttaccggattttcaggacccgctgcgacgtcctgggctacgctagcggttaagttaccttccccatccgttaatgcatagcccttttcagtaattgaaaacgtaactagttgcaacgactgactttcaaatgctttgcgtaattcttggctaggcgcctctgcagaatcaaaaactgcgtctgcaaccgaaccaaagactgcagattccaatgtgccatccgctttggtaacgacccgcaagacttggttgtgattatcgtggtaaaccctttcaacaacttccttactaaaggtatcgactactaataaaccagcgtctaactccccttgttcaatcaactcatccgcaatagccgcgtgaaacgcccggaaaaggttgccccctccgaagtgaatccaacgggggtgggtcacccctttttgcgcaacggcatcgtggtcgtaagtgggaaccttaattccggccttttcaaactcggcccggtgggtaatgtaattatcagatagcttaaccatttctatttttcacctcaaattgatttaatcgaagaaaccaaagtattcgtgtgcgttgttgtaagcaatgttttgaactaccttgcccaaaatctcggcatcgtcaggaacccgcccttgtgctaccaagcggccaaagaagttgcacagtacccgccggaagtattcgtgccgcggatatgataagaaactccgggagtcggtcaacatcccgacgaagtttgataaaagactttgttgggcaaagacccggagctgttcgtccatcccttcggcagtgtcgttaaaccaccaggccgctccaagttgaatccgttgtttggtttgaccttggaaggattgcatgagcgttgccaattccatccaatcgtttgggttaagggagtagaaaatcatcttaggaaccacgccctctgctgacatcttggtcattaatttttgaatgccgtcgacgatgtctggttgagttcccattgagtcaaaaccggtatccggacctaatttttcgtacattggtttgttggcatcccgcaatgaattgatgtggaattgcattacccagtcaaattcgttgttgagtttcattaaaacttctaacaatgcggttgtgtaaccgtcgcgttcgcgttctgtcagagttgctccatcggccgccttggttaaaatctggtctagttctgcttcagatagctccacaaagtggtaggacggcaacgagtggtcggataaacggcttcccatgtccttaaagaattcaaaacgctgccgtaacgccttcgccaaatcttggaaggaattgatggttaccccagcggcctttgcgagggtttgcaagtattcgccaaatccaggcttttcaatctgcattagtttatccggccgcattgcgggaaccgtcttgaagccggattccgcttcttcgtcttgcaaaagtttgtgatagtgcaaatccgaagccggatcgtcagttgtcgctactagcttaacgttggaatttttaatcaagttgcggggtttgaaatcatcggtcgctaataattggttggccttctcccaaatttggggagcggatttaacggtaagtggttcatcgataccaaagaaccgccgtaattccaagtgggtccattcgtaaagtgggttaccatacgcatgttcaatggtatccgcccatgccagaaatttttggtattcgtcgccgtcaccggtaattaaatcttcgctaaccccgttggcccgcattaaacgccacttgtagtggtctccgtaggtgccttcgtttagccaaatgcgactaatgttgggatagtttttattttcgtaaattgcttggggacttaaatgacagtgataatcaataatcggcatcttttctgcgtaatcgtggaaaagggtcttcgccatttcgttttccagcaaaaagtctttatcaagtaatttcatgactgctaccttcctttattgatttagtcttggggttcgtatttatctaaaacagcttgtttcgtggtttcgattccttgtaataggtcaacgtgttccgccatgtgcaagctcaagtacttgtcgtattcgtcagcgtgatgaagcaaaatatcaaacaaacggtcccggtatacatattggtagttttcggtgtacccgaggatcgaaccgtacatcgtgtgcaaaacttgccgtgcgtcgtcatccacgagcagcatgttgacgtctttttcggtgaggtcttcaggcttgggtgccttgccatcagtttgcgcgttgaagacgtagaagtcttttacgtcatcaaggttgtcatagctaaacttgtaaagttccagcataaattggggatcttcgtgagcaaccacccggagcgcctcaagccagttagttcccgccgtcttaacgtgccaaccgtgctggttagccaaacgggcaattactggataagccgaaagtttatcggaaccggaatgtacgctaagtttgtagccaaacttctcggcaatcgcttcgtgttcgccaaagtctttttcaaaccggtcaaggtcgccaatgtagtcaatcgccttttggaattcaccgtagaaacggggagccaaggtttcgggagtaattccagcatcggccaattcgttggcgaagaagtagtgttgtgcaggagttgtagaaaccggggtctcgtcaaccgaaacttcaaaatccaaggcgtatggtttaacaaacttttcgttgacccattctgcgaagaggaccccttcgttaaaggccaacaccgcttccttcaagtcccgggggctaaattcgaccacgtcgccgttgcctaattcaaagcggtggttgaggtacttcttttcaaatttttcgcgaatttcaggggctaattcgttatacttcgcgtccaaatcttcatctgaataagctaagtattcgttatgggtcttttcggtgaggtctaaagtaatcatcgttgcgcccgaacgtaccgcgtagtcaatttcgtacgcattcttaacgtggtcgccatccgcaccccagccgtcgcggtagccttcttcaaaaactgaccatgatgctgcttcaattacgtcggtgaaggtccggttactcaataacagttcccgaattgattgttgggcgagtacggggaaaatgccgcgtccctttaacaatttcaaatgggcgttagacgcaattccaagccggtcgcctaagccaagcgtgtacttgtgaccgtgccgggaagacggtttaatccaggcaaaccgttttgctagcgcttggttattgaagaagttcagcgggcccttcaataaaacgtagtcgtcatcaactaaggtctcgtcagcttggaaatcgcgagcgttgcgggcatcttcgtaaactaccaggctcttcttaattccttcgcgatagataaagtaaacgttgcgccggtcaatttgtactgaagggcggtaaattccctcgtcaacgtccgcgtccggattttcaatcaattttttaacatccaatagtaaattttctaaagccattccaattacctctttcttaaattacaaagtgcccttttcccaacggccatggtctaggtcattagaaatccggttaaacttatcatcatccaacttaaacaagaacagtaaaattacaccagccagtgccaaacaaattgccgggtataaagtcatcgcaatcttaattccgttgagcgcagaaccagtttgcgtgtggttagccacgtaaccggtaattgccaacaatcccgaagaaactaacgccgcaattgattgggcgatttttcgcgagaagttaaacgcggcgtacgtgattccctctttacgtgtgccggtatgccattcaccataatcaatgacgttagaaaccattgcccaagtaattccgttcgggattgctaacgctacgtaaccaatcgtcacgaacaggatgaaggtgtacaaatttgtcggcaagaagaagttgattgcgttagccaccgccccgataaataagctcacgatggcagttttcttttgcccgaaatgtttggttaagtacggaaccatgaagaccccggcaaccgaactgcccatcatgatgaagttaattaccggttgcaaaccgatgttgcccaggttgtactgtgcgtaaaagaccatcatttggttattagtgttcattgccgaaatcgtaaacagcgtcattaaaactaacgcgcccaacggtccgttagtgaaaaccaccttaaagtagtccttcatgccttcctttttggcatcctcgtcgcgtttgatatgtaggttttcgcgcgtgcccaggaagcatactaagaaacccagtactcccattacgccaaagatggccgcggaaatggtatagccgtgtagcgggtgcccaccgctagtcaattgcattaatgggataaaagccaccccggcaattaattgggccgctaccgaaccaatttgccgggtggtggacatgaaactccggtcctccaagttccggctcattaccgaagctaacgatccataggggtcgttagttaaggagtaaaagacgccccaaatcatgtacgttattaaagcgtaggtgatcttttgcgtcatggttaacccgcttggcatggtaaaggtgaccaccgtcataattgctaaaattactgccgaccccatcatgatcggccggaatttaccgtgcttaccgcgcttacggttatcaattgccgcacccacgatgggatccatcaccgcgtcaaaaatcttagtaaacgcaaaaattgccccgacgactccggcagcaattccggtcccgtcgatccaaaacttggttaaataagcttgcccaaggtcaaacatgaggccattccccatgtcaccaaatccataagcaatttgctgtgatttagggattcgcttggtggagtcgttgagtaaaacttcatgatctggcgcgctcgaatgtacactatccgccatattttttacctccgtaattagttgtctcccaaaaatgttcgcgtgaacatttttgtgcaaccactactattaatttgaaaatctaacctgtatcctagctcaaccaagaaagttatgtagtccaaattcacgtgaaaattagctgactttcttacacggttatgttaacacaaccgttatgaaagcgctacctttttctggcgattaaatattattaaaggcaattttaagtaaattggtatacgcacgtttactttattcttaagcgagtgggacaaaagttgggtagtttgcgagcattaactgaaaattgaccgataccctgtccattacaaaaaagcccgctcctttttatccggaggggctttccataataagcaatctcgttgtttcaccacgattaattggaattttctatttaattttagaatacttgtctgtcaaagaatcggcatttcggttttataatagctaacttaaccgcttgtcaaaaggcgttctcatgaaattgctactgactaaaaaggattatttaattgttttggcaattgtatctaaaatccgagctgctgcgtgaccgtctccgtacggattttgggcttgggccatttctgcatattttgccggatcattcaagaggacgttcatttgcttcttaactgcttgcgggtcggttcccactagtttcaacgttccggccgcaaccccttctggccgctccgtcgtgtcccgtagtactaggaccggtttacctagtgaaggagcttcttcttgaacaccacccgagtccgtcatgattaaataactgcgagccgcaatgttatgaaaatcaaggacatccaacggcgcaaccaatttaatccggggatcattgcccaattcggcctccgccatctgttgtactttggggttcagatgaactggaaaaataacctctacgtcgggagtttcatccactacctgccgaattgctttgaaaactcgttgcatcggcgccccttggttttcacgacggtgcatggtaaccaagataattcgatgatctttaccgatttcttctaaaatttcgttatggtaatcttcactgacggtgtccttaagagcgtcaatcgccgtatttccggtaacaaaaatttgcttttcggggtgattttcttggagtagattatcccgactagtcgtggttggcgcgaagtaaaggtccgtcaacacgtccgtcatctggcggtttaattcttcaggaaatggcgagtacttattccaagttctcaatcccgcttctacatgacctactggaatctggtgataaaaagcacttagtcccgcagaaaatgtggtcgtggtgtctccgtgcaccaaaatcaaatcaggacggtctgcttgcaagattcggtccattcctaagaggaccttactagtgatgctgcttaaagtctggtccttttgcataatgttcaaatcataatctggcttaattttaaaaatcttcaaaacctgatcgagcatttccctatgttgaccagtgactaccgtaatcggagcaaagcgctcgtcgtgtgccatcgctttaactacgggagccatttttattgcttctggacgagtcccaaaaatactcattactttaatctttttcataaattctcctcctgctcgactactaatccaattttaccattgaacgccgtttacgtttcatccgctggatctagatttgttaactttcaagcctggttgggatggtttgactacaaagaaaggggctgaaaaaactaatatttgggcgtactggctttaagtcaattggttccgcttaaaccaaaatcgactattatacccagctcaggcataatagtcgatttttagttaatattcacaaattacccgacttttgtttcattctccgtccagcaattttatctaattagttagtacttgctgttttagttaatttaacgtccgtagtcttgtattttccgctatggtagtaaccaatcttaacggtatcgccaaccttatgcttgtatagcgcttcgcgaagttcggccgtgtccttgattgattttccatcaactttcgtcaccacgtcgtacttcttcaagcccgcagtctttgccggacctgcgtttaccgacatgattaccgatccgcccgttacgctgctaggcaatttcaagattgatttttgttgatctgaagagattgccgttaaatctaccaacgttactcctagcgccggacggttaattttaccgttcttcactaattcgtcaattacagaaaccacttcgttagatggaatggcaaagcccatcccctctaccgaagtcgagctaccgcttgaagaaagcttcatcgaattaattccaatgacttgacccgccaagttaattaacggaccaccagagttaccagcgttaattgcggcgtctgtttgaataaccgtcgcttcgccagtaccttggccgttgctatttgacgtttcaatggtccgcttcttcgccgaaataattccttgcgtcaaggaagttgcgtattccgatcctagtggtgaaccaattgccaacgcagtctctccgactttgatgttgtcagaatcgccaaaacttgccacggtggttaccggagcagagttaatcttgaggactgctaggtcggttacgctatcggttcccacaattttagctggtagcttctttccattgctcatgataacttcaagcgaatttgagccgctgaccacgtggttattcgtaacgatgtacgcggtgttaccactcttcttataaattaccccggacccttccgaagccgtttgaagcttatcagaagaagacttgcttgacgaggactcactgtccccaaaaattgaatttaaaatattgtcggtgtcgcccgtattttctttttgcaaattaattacggaaactacggaatcctttaccgtagaaaatgcttttgaagattgactgctaacgttaaccttcacgttgcttgtctgggtttcccctgatttatttgaaccagttggaactgccgtagtggtggcttccattcgattttgtacaaagctcgccccaccataggcaactccaccaccaagcaaacctgcaatggcagccgtgataataatcttattatttttcataacacgtcgcggattcccgctccctcctcatacaatattcccgttacggcctattatagcctgtaatttatgttatttgtatgaatttactcggtaaatttcctaaaaggttaaaaattagattaaagccagcggatccgctttttcatggtccgtatctagaatttcaaaatcatggccaaccgctaaatcatggttttgcatcatggaactcaccgttagatgggccaattccttcatgttgttatgcaaactcaagtgacctaagtaaattttcttagtacggttgccaatcacgtccatgagcgcgttggccccgtcttcatttgataaatgaccgtgatcgcccatgattcgctgtttaagcggccacgggtagccgcccatccgcaacatttccgtatcgtgatttacttcaaacaggtagccatcggcattgcgaattgtgcccgcaacccggtctgacacgtatcccgtatccgttaatattacgaacgattttcccgcgtgatgaaattcgtaaaattgcggttcggaagcgtcatgtgacaccgcaaaactttcaatatccaagtcatccaacgacttagtcgtattgggatcaaaaatgtacttttgttcggtaggaattttaccgaccttatttttaatggcatcccaagtaccccggtttgcgtaaacgttgatcccgtactttcgagctaacactccgacactttgaatgtgatcagaatgttcgtgggtgacaaataaggagtccacctcatgaatatcccgaccgacactttccattaacccggcaattttcttgccgctcaatcctgcatctaccagcaccttatgttcgggtgtctcaatgtaggtaacgtttccggtgcttccactggaaagcacgctaactttcaaaccctcttcgctcatcttttgaccttcctacttaaaatttaatccattaacaataatttatgcgttcgaactatttgttgacgcagtaccgtcctctacagattcagcactcgtgccgttcgtatccgtagcagctgctttatccgtggttttagccttctttactggggtttgaccgtcttttttgatcaacactcccgaaaaggcattaattcgtttaacctcaatattagcactatttttgtttttgattccaattacccaagtaggcacgtaaactgcaccctcatcagtgcttagcaacctcgtgtatcccaaattagcccactcaattttagagttattgggaatttcgttgtattggtaaagcagggtgaccgcccgcgattggctaatcagttcgctttcttcacgaagctgttttttagctaccaaatgaccttgcacgtagccggtaacttgattactggtatttacgtaaaaaataagctggccgtccttagaatataccggacgctggtcaatcatctgggtataaaccacttgcgtatcgctgcttaagttcgcattgtactgatactgcgtgccagcaattacgttttcccgatcctttaaaaagcggtctaaagccttctggggatctttgggatcgatggtaaatggatcggtgatcgtgctatacaacttattatcaaccacgcgcgcattttgcccagtaaggtgcttaatgccgcccttgagggaagtatccactttgctttgggcgtaatacccttcctttttcttgttagaaagtggcatatacgtgatctggtcgttacgcatctcctttaaaatggacgtgctcgcgctagtatttgacgacgtgaccgtgcccgattccatttggtattgccagtaggaaccgaataaataggcgtttaagatggcaaaaaccacgatgaaaattacttcaattctcctaaaatccatttcgttcctccttagctagccaaattttggtaggccgtccattcaccacgataattaacgtaccacgttggttctaattctaccgtcgtgttggccgctactttacccgcccattgatatccaatttcaatgtctttgatatctttaggattaattccttggtaactaagctgatttagtacttcttcagtcgtaggtagctgtttggtacctcctttagaaggaactggcacctgtaagttgtaaattgaaaaagacgttgtcagttcgttggattgccgggcaaccttaatcgtgcctaaaccatcctcattgaaaatcgggaatccggcgacgtaatcgcggaattccgcctgccgtttagctaattggaaatcaaagtagcgcacgttggtgtcagcttgcactcccagttgtttcatctgcaagaagctcttctcgatattattattcaggccatctccgccgccattaccgctcgcattattaaaagttacctgaccattattacggacaagaaggcgtttcgtgttgtcgttagttacgtacaccaccccatccttggtcgttttggtatcaattgaatccgcatccgtgttggtcaacaagttggccgtaaatacgctgctgctttcctcgttaatcaaaaagctgttgtatggtaccgccggagccttatagtaatcgttgatcagccgatgattcatgaccgtttctttaactgcataaacttggtcatttccctgcactagttgtcgtaaattctttaagttctgcctgctgactttaatttgataaacgtcgtaagttttatcattaagtaagaaaaactcgtttcgtttatctagattaatcaccacttggctaatttcgtaattggaatttaacttctgatcgtaaactccattaaaaatttgcgtggtaatgttgctaggatatttcagcattacgctacgatccatggtggcgtaatccataaaccgttccttattgccgcgtgatactcgcgtggagctttccaaacgccatttactaacctcggccacgatcatttttggtaaatttttcttagaattattaattaattgttgtttatcatggttagtgtaaataatttgagtaggtaaaattacgtcgctcatgtcccgtttaacttggttagactgaactttttcgtttgcaatatggcgtgagccgccgtaacgcgccggattcgtccaaattaaccacgaaaggctaatgctcataatcgctaaaattgctaaaagcgcgtggcgaataatgcgccgggttttcgtatccttcattattcccaagcatccccttcctcaaacggttcgtacggtagcgaaatgtagaaggtcgaaccttcgccttcgcgactttctacccaaatccggccaccgtgcatttggaccacttccttggaaattgctagccctagcccagtaccgccttgtgctctagaccgcgctttatccactcgataaaagcggtcaaagacgtgactaatcgcttctttgggaattccaagtccttggtcagtaatactcatgatcacgtggttatgggtctcaaccagccgacaagtgattaccccgccatccggagaatacttgatggcgttattcataatattatccaacacctgttgaattttatccgtatccacttcaacccagatatcgcgccgggtgaaatcccgtttaatggtgtaatttttctccgatttttccccattcttcaaaatcatatcaaaacgatccagaatgtggttaaatagctcgtttaaattaacgtattctttatctaaccgcgccgtccccaagtccattcgggacagatttagcagatcattaatcatccgcatcatccgatcggtttcttcttgggtaactttcaagaagtttggcgcaacgttcggatccttccaagccccatcgacaagtgcttcaatgtagctcttcatactggtcagcggcgtccgtagctcatgcgaaacgttagatacgaagcgtttccggtcttggtcaattttttgttgttcagtaacgtcatgaagcacgcaaactaacccgctaataaacccggattcccgttgaatcagggcaaaggaggcgtgcaaaatcaaatcctgttcatcggtagacaaatctaacacttcgggatcttgattttccaataaatcacgcagtgttaccgaaccgcgtaagtctaaaatgtctaaaattgacttgcccacaatttggtcgttttccaaatccaaaaagtccgttgccatttcgttgacgatcgtaattcgaccccggcgatccgtcgccagcaccccgtcggtcatgtaacccaagaccgagtctaatcgccgtcgttctgattcggtcagttcctgcgattcttcaacccgaactgacaagtcgttaacggccgcggcaagttggccaagttcatcgtcaccgtaaatctggacctgtccggagtaatctccccgggcaatttgcatggtccgttgccgcatttcttcaattggtcgcgtaatcgcccgcgcaattaagaccgcaaggaaaagaccaatcgtaatcgcaattagggccgccaccacgaaaataagcgtaatgttattcacgttttggtaaaccgactctaagttggcccgaatgtaaacaacacccgtcaaattattggtagctcccgacgtgttaatgaggggaaccaccgaaataaagtaacgcgtgttattcgttttattataagaaatttgttggtaactgcgggtgttataaataacgtccttgacgttccggtcggtagttttttgtccgaccatgctccgatcggcattattactagtcccgcgaataactcccttagcatcaattactcgaatttccgtgatgttttggttattaatattgccaataatgtccgcaatttggtcgttcgcctttttcgtgttgctgcgctcaagttgcgcgctaatttcattttccacgtacggttggagttggacttgcgacttgaactggcttaagttttgcgtctccaattgacgcacaaaaataactccaacgacttccaacgttaccaccagcaacattgcaaacactagagctattttaaaattgatcgatctaaaaaaatttgttcgcttattcatttaaactccccgagttctaactaattgattagttaaggaaacaaatcggcaattgcgtgcctaaaataggccagcctgcttagccatggggattcttaccgaactccggtaactaagttctactggccaaaggttattaatcgtgatgcgcttttgcaaccgttgagttggcgtttaagccgttcgctgagttaggcaggcatcataacccattccaaagttaaacgggcgctacttccacttccattgcgatggcgcagcgaccgatatttttctattgattagttgaaacgtgtttcgtagcccgatttcttgcggttaaccaaattctactgctgcgtggccgaaacgtgttcaagtctcccagccttctgcggttaaccaaattttactgctgcatagccgaaatgagctccagccctcagctctttccggttaaccaaattccactgctgcatagccgaaacgtgttcaagtctcccagccttctgcggttaaccaaattttactgctgcgtggccgaaatgagttccagccctcagctctttccggttaaccaaattttactgctgcgtagccgaaacgtgttcaagtctcccagccttctgcggttaaccaaattttagacccaatcgctggtcgcgattaagtctaaaatccagttaatcctcaaaggctacccgggagaattgaacactctagtccgtttccggatttctcaaataatatcctactccccggcgcgttaccaaaatttgcggattacttggtgtttcctcaattttttcgcgcaaccgtcgcaccgttacgtcgaccgtccgcacgtcgccaaagtaatcgtagccccacaccgtttgtaagaggtgttcccgggtcatcacttggtccgtatgttgtgccaagtaatgtagcaattcaaattcccggtgcgtcaaatctaattgcgcaccgtcccgagttaccgaatacgaatccgaattaattactagtgggccaatcttaatgttattttttacttcttcattgctttgttggaattgatcctgccgacgcaagttagcttttacccgcgctaccagttcccgattggagaacggcttggtaacgtagtcatccgcaccaagttccaatccaacaaccttatccaattccgaatccttagcggttaccataatgattgggatgttatgcttggcccgcacttggcgagcaacttctaacccatcaatttttggcaacattaagtctaataggattaggtccggttcctcggattctactttttctagcgcttcttcgccgtcataagcagttaccacatcgtaaccttccttatctaaattaaacttgacgatgtcggaaattggtttttcatcatctactactaaaatttttggcatgtttgccctcctcagaagatatatctgccattagttgtaagaagttgggacagacacttaattaattttcaaacgtttggtcaccggcttagtgcttcaatttcacattaagctaccgtcaaccaaatttactaatccgattttgtccatataaatacaaattcaaaaaaagttgcggatttttttgccatttttttaggcaaaggtctatcccattcgtttctgtcaattataccacatgcgctcaaatttgaatggtaacgctctcgcagccccttattagctaaaatttcactttttttaactttttttgaaaaaaattcaaaaaaagtgttgtcatgattttttttttatgctactatatttaagtcgagctgatgaggacatcaatcacatgggtggttagctcagctggcagagcaacggactcttaatccgtgggtccagggttcgatcccctgaccacccattacatagacacactaatcagtaatcacgctgcgtcaggccgtggttgctgatttttttgttgtctacatttttctctttaacaaaaaaacagcaattaaatgagtgctggtttttttgtgctcaaatttttttggactatatctctattttatttatagagttttagatttctaaatcactagcgatcaagtactggcaaatctttgatcttctttgctggcactccgccaaagatagcattatcagggacgtccttattgactacggctccggccgcaataattgtattgttgccaatttttaccccaggaagaatagtgacgtttcctccaatccacacatcatttccaacctcaataggtctggtagtggaaataacgtaggaactcccatctgagcgctttccaaaacgtttgcttgcatcaatcgaatgctcaccacaataaaacttaacgtccggtccaattaacacccgatcaccaatggtgaccaaattagcatccaaaaaattggcattagcgtttattaatacatcatttcccagtcgcatatgttttccgtacgtaactcgaaaaggactaattatggttacattttcgcccacgtctgcaaatagtttcttaaacaatgccattcttttactaaaatcctgagtctgattaatttctttcgtcacattctggatcattgtttgaatttcgggatcccggtaatcatagtcttttcccgctaataatttttcatgttcgcttagcatgtgtacactctcctaacaaaatcattattttttctcgtcaattaggacggttccttcagctggattttcgtcaagcgccccaactatcttatgtggtacatataattcttctaagtaattaacatcctctggtgataagtcaatcgataacgcagcagctgcttcatcaagatgattcatcttagttgagccaataattggtgcagccacgccttttttccattgccaagccaaggctatttgactcatcgaaacaccatacttttcagctaattcggatactcggtcaacaatttcttggtcttccaaacgggaatcatcgtattttccacgtgctactcggtcggtttgactacgtaaagtgttcgcctgccaagccttatgacttaaatgtcccgctgctagcgggctgtatggcattaatgacacttgcatttgattacaaattggaattaattcacgttcatcttcccggtaaagcaggttgtagtggttctccatagtttgaaattgcgcccagccgtgttccttggcaatttgctgcatattataaaattgatagccatacattgctgaagcaccaatcgcacgtactttaccagcctttactaaatcatttaaagcttccattgtttcttcaattggtgtttcataatcaaatcgataaataatatataaatctaagtaatccgtgttcaagcgtcgtaaagagccctcaatttctcggtgaatcgccgctttagataatcgtcccggattgaaataaactttagaagctaaaactacttgatcacgaggaattttattctctttaagcgcgcgtcccaggtattcttcgctagttccttcagaataagagtttgccgtatcgaagaaattgacccccaaaccaagggcatggcggatcactttttcactgtctgaataatcgagtgtccaatcgtgcatactccctggtttgccaaaactcattgcgcctacacacatctttgaaactgctatatcagtctttcccaacgttgtatattgcatatctttattcattgaactcatcctttcagtttgttaattattaaatcttgccagttttcaacgaagatttttcttttttgttgtttagttaaactgcttgtctggattgcttgtttaataatttgggtaggaccatccggtttgactccaagaggggtatctgtaccaaataatacatgccgttccccaaagaactctacagccatctctaaggcctttggattacccaatagagctgtatctacataaaattttttgaaatcttcatagttatgctttccttgaatgtaataaatccgttgcgcaaaatatggcaccattgctccggcatggtgaacgattatttttaaattaggatatttctcaaagtaaccgttattcactatattattcatagcaattgtttgttcatattcccagctaaaaattaggttattatctgatttgcgttcatcaaaaacgggatgcaaccaaattggctttcctaagcctgccattttttcaaaaatcggctcatattttggatctgtgatgggctttttcatcgctctagtaaacagttgcacgcccaccaacgctttattgttagccacctggtgatcaattattgataacgctgcaggaatgttattcattggtaacatcgctacggtgcccacaaagtgcttcggttgcgcttcaaccctttctataagttcggcattggcagattgacacagggaagccgctaaattgggggcaacccaatcttcaggattcaggttaaccattgaaatgatttcttgctggtcttctgtcattgtctttactcgccttttaatatccgttaataatggattttgcatccattcgttattttttaaagcattcggcgcaatttttaatatctcagcaaggtagttaggcgttaaaacatgcgcatatacatcgaccatcgaaatgcctcctttaataacttcgctagacaccatccctctgcgattgtttacaattctactgcttaaagtacactttaagtcaaggaggattttccatgaaaattaatgaagttgctaaaatgtttaacgtttctacttccaccctgcgttattacgaaagcgagggactactcggtccaattaatcgcgttaatggcgttcgagaatttaccaaaaaagatttagaaagactggatttcattatttgcactaaaaattgtggaatgaccattactgaaattaaaaactttattcaactttaccaaaggggaaacgaaactatccccagccgtctagccatcttaaaaagacagttatccaagtccgaaaagcaattacgcacacttcaacaatccattgaccatctaaaagataagattgtagatgttcaaaatttgtcggcaactgcagataaacaaaacctcagaaattaagtcatggctataatttctgaggttttaaatttattgtattttttgcctaaaagtactattctgcccaatcctagctaatatcagtagatttaatagagcaaccactaccgtaatgaatattatttcggtagcattttttaactgcaatgtgcctccccaacctagcaaggtaaagcctattatccagcacacccgtccacttccaatcttaaagcttacttcgttgtaaataccgcctaggaggattccaacgtaaaacagcaataatcccgtatataggcatccaacgctaaaaattaggttagcattagtgctatggataaacttaattgccaccgtaattaaacttaacccaaataaaatgaagtaatgtaggtaaattaatcgattccccgtttccctaccttgcttttcttcaattagatcgctaaattctgtagcatatgtcatgaaaagtagtgccactagcacaaataataagagtgaataaggcgaaaccgtccgttgggtgaaatattctgctattcctacaatcatttctccgaacataataataattaaagccgtgacccgttcaagtaagtgcgaaaaaataattggtcggcgtacggttaatttaccagtaaagcttggtgcaatccaactaatcatgattcccagtaacgcggccagtagtcctagttggttttgaatagcagtcccgatggttaacgctaaggtcctcgtagctaagattccgctgaaggctaaggtaatttgtttatctgcattctgaatcgtttttaaatacacaattacgtattgcatggtttgggtcaaagacaacaacgcagctgcgccaaaaaagggtgtcagttgatgattaaacgtacttgaaaaagagtttgacatatacaaaaccacggccatattaataaaaataaataatttatttgatcaagaatcgttgccataacggttgataaagacagtttgaatcatccaagaattgataaataaaattaccactaaagcaaaaatagaaaaagtgcttaatccaattactccattatgtaaatgatgaattagacctgtggcttgcgatatcatgtataaaaaaaccaagtcataaaagagctcaattaatgatacttttttagtaactaaatcattcatcgttctttaagattgtcctttcgtcttttgttagcatttaccattataccctaaacatttagtgcgcttaacttcccacaataaatgggcatgttctaataggataatgaagacgacgagcctccttaagggtatttttattaattactatgtagatatcaaaaacgatcaaatacttcataaaaatagttagctaaattttggtatttccctttgaagcaaaaatttttaaagcatataataactccacttcatgaaagagaggatacgctgtttcagcttagaatttacacaattaacaacaataaaaacgcagatatttatttagataagcattggaagagacatctggtgagccttcctaaacacggcatcaccgttcacaatgtatataaagaagtcggcaccgatggggaattccgaattttcgccttggtttcttctaccagggatctcagcgcacagaataaagaatatatggacagcaaggatttcgtcgaggatatggcaggcttcgacatgtccgcaattaagagcgttcaggagattaacttagataagaagtattaaaaaatatttggacttttctgtaacttcactacaaaaagggctatatcttcaattaaagtacgaagataaagcccttttttcatcccccaaatggcaaccagccccacttcttggaaactcgagggcccatagttttttgcctatacttaaaatagtcggttccaacttgtttcttaaacgtcgtaggaacttcctcgtaagtaattaatcgtacattagacacgtaagagccccgatgcgaaaccagcacccatttatccttagtagtatgtcgtcccgctttaaacttaagccactctccattaccaaacgggtcatccgaaatgaacgtatccacggacattttctttccttgtggtaacaccccatagcctattttcgtggtcaaaaaaggatttaatcgatcaatcgtagtattttgggtcgctcgcccgtaacccagtacaactaatagcgttaccgaaacacctataattaacgaaaccattatcaaagcccggcgatatttttcctttaatcttacgtcctcactaattttattgaccaccgtcatcccttctcccttcaaaagttcgtctagcgttatttccaggcattcgctaatttttactaaaacatccaagttgggataacttaatccattctcccaccgcgaaaccgtctgtcgcgtgacaaataactggtccgctaaagcctgttgagtaatttggagttcttttctacgttttttcaacaccttcgaaaattccatcacgtcctcctttatttccagattaataaaaaaagcgccaaatgtaacgcgattatcgtgttacatccgccgcttctaaccctaattactatttttccttgcttaaatcctgattaatatcaatgacaatttttccccgtgcatgcccttttctagaataatctaaagctgcctgagtctgtttaaaggtaaaagttgagtcaataatgggtttcaatttgttttcttcaactaactgggtgatttgggctaacattttgccatccgggcgcataaaccaaaagctgtaatccgccttcgcctggcgcgctagtttagttattttgtgggaagcaatcgcaaacaacgcctgcttccaacgcggtaatccgtaactacgggcaaatttagcatctggaattcccgaaattgtgaccactttaccgcctggtttaaccaccttaaaagcattctccaaattctggccacccaacgtatcaacaacgtaatcataatcccttaacttttctgcaaagttttccttacgataatcaatcacgtgatctgcgccgagctccttaacaaacgcgacgtttttggtactggtagtagtcgcaacttccgcacccgctagtttggccaactgaattgctaccgtgccaattccgccagaaccagcttgaattaaaacccggtcgccaggcttaatttgcattgcttcatgcagcacttgatagctagttaacgccactaaaggtaggctggccgcctcttcaaaagttaaattctgcggttttacggcaaggtcaccttcattgaccaccaggtagttcgtaaaagtccccatccggtccttttgcaccctaccgtaaacgtaatcccccacttggtagtttttaacgtttgaacccactttaaccacttttccagaaaaatcactaccaattttcaatggcattttgtacttcagaattaacttcaatttaccttcaattatctttaaatcgaccggatttacactcgcggcaactacctcaaccataacatcattattctgaacttcaggaattgcacgttcaacaagatttacttcggattgtccatattggttaatttctgctactaagttttgtcttttcataaattttaactctcccgattggtttatttttttaaaccattactttttgcagtatcttaccttgtctttttaaagacgtcaagtccttcaacttaaaccttttatttgacttagttcattaggcgtggttaaatggtttaaaaatatgaaccattaggagctttcaaatggacaacctaaatcaaatcaaaaccgaattttctaatttgagtgacttcttaattgcgattggggacgaaaaacggcaggccattattatggctttacttgccgaaaatgcctgccaagggttacgtgcgagtgcattaacctcggtgacaaagctttcccgccccgcagtttcgcaccaccttaaaatccttcgtgaggcccatttagttaagtaccagcgagtaggcacgaagaattattattatttgtcgcaccaaattaaagaaattgagcagttacaaaatttgctgacccacatcagcgagtgcattaatgaaggagattaattatgcagaaagttttaatagtacttaccaacgttgatcattaccagggaaccactgatcttacgggactttggctgggagaagctgcagaatttgttgatgaaatgacgcaggcaggcattgaagtggattacgtcagcccgcaaggtggatttgttccgcttgatccgcgaagcatgaagtatgccgactctgcaattcttaaaatctacgagtcggcagattttaaaaaacgggcgttgacggcatccctagcccctcaagacgttaaccctgccgattattctgcaatttattacaccggcggtcacggcgtgatgtgggactttccagataattctgaacttcagaaaatagccatggcaatttatcgtcaccatggctacatcagctccgtttgtcacggaattgcaggattactcaatcttaaggaagatggtcaatacttgattaacgggaaaagcattaccggctttacgaccagtgaggaaatccttgccggaaaaaaatccgtagttcccttccttaataaaaaggcggccgaagatcacggcgcccattttcgccaaaagttagcttaccgaaagtatgctatccaagatggtcgtttaattaccggacaaaatccgttttctgttcgagcggtagccaagaaattgattgctgcgctgaaaaaccccgctgctttataaacgggtaaataaagcggaaactaaaaaaatccgttttaaaaacggaaattttttgaaaattcattttagtgtgttgagtttaatggagctaaaattcagctctgtctgcttaaccccaagtcgaccattgtgccaaattcaagcataatggtcaatttttgttaattctcaaaaactgcttaatttttgtcccactatctttaccgttactacaattccaccacccggtactcaaacccaaccgcttcaataaacttaaacaagtcggtagtggctaaaaagatggtctgctcgttggtattgggatggaaactcatccgttgctcatcgacaatgtccttatcaaagtaaacctggacatccctttcaacgttatttaatagaccaaacggggaaactatccccggagccaacttcattttttccattaaactggcggacgaagcaaggtgcagacgtttttcatccacgatttccgcaaacttatgcatgtctaggtgcttttgatcatccataattaataaatagtacgcggatttccggcgattagttaaaaacattgatttcgtgcgaactcccgaaattcctttaatataactatccgcttctgcggtggtcattgccggcggatgattgacaatttcaaacggaatgttgagttcggttaacttggcttggactggctgacttgcttccattgatagacctcctatttttaacctcaaactaaataacttcttaaactttgtcccttctagctagctgcgtatacttctttacaaactcggtcttggcagccgtatagccatcacgatcgtgttcataaggcttccaaagcgccagtttcaattcttcatactggtgggcaatttcgggatgattatttaggtaatcccgaaaatatatttcatcattatctccaagcacccgcaaatgaaggtgaaaaactcgttcggcaaaaccttggggcaggtatcccttattaaaatcactccggttttcccgttgcgccatgcaaatgtagtcgttttgttccaaaatttctttaatcgctgcataactggcgtgaggggcttccactaaaatatcgacaatgggtttagcccaaatattagcaattgccgtacttcctacgtggctaattaccgcgttggccgggagcagctgctttaaacgccgttcttcttctgcataccaagtttgccattttggttgaggggcaaccagctggatgggaaaaagctgccacagttcttctaacgataaatcggatagcgaatcactcatcgtcatcatcctcccgtacttgcatgtaatgcgccaactgctcgggcatgtgccgtggtccccgaacggtggtgaccccgtactgttttaaaacggggagcgcgaattggtttttgtcatactgccttatcaaatgaatccgcattgccttattcattttaatattggcatcccggtaattttgcgggatgttaacttccacagccaaacacttgtacctaattgccgaaatcggcgacgttacgtaaaggtacaccaggtcgttcaccttaatattactggtctgtttccaaatgatggtgctattttcgcgaaacgcctgatccacatcaaaatatttagggttagcagggacaatccatttttgacctatgtgcgcatgattatcaaacgtgaaacattggtcggcaattgattttaaaagtgctacataggtttcacgaactttacccgcgaactctccagccacgtattttgctcggaaattggtgtattcatcgtcgaacgctaaatcaaaaatgtgccccgtaacttgtccagtgggggctacactaatttttaccgaaaaatcaccgttgataattttcttagtaaaaactagttgaccgtctttttcttgaaaaccatactttagcaaccgttgcttaaccggtttcaagtttcctaaaatctcatcttcgatttccaaagatttttcctccatacatttcactgttcttcaagtccaatttaacacaaactattcagaataatagagttcgcctaaataattatgtacggttgtttacttaaccaaaaggccacccagctcaactcctcccctgattggcactctcttaggcttatccagccatctattttcttcaaaatacttttctagctctgagaaatcatcgttactttattaaatctttcatcactaattctttcgggatatttatagctactaatcgttacaagcataaaaatcgctattaaaattagtaccccttataattaagaaaaacccagtattatcatatttctttaagattggtaagaatagtgtaataattaattgttggtgtttttttgaacttcaattgtacttaataattaagttaaattaaggagaagcttatgccattattcgcgtgttttctggattttttagccctcggaacttacttcatccagttaaatcatcctagtaacccaatttacgtagtgggaaccgtcattcaaataattattacggttggcttattattaatcgcaatcggttaccgggggccacgctttaccgcttggcgaccggcaggttttagttatctcacaattcgctacggcatcattattatgtcgctggtgatcaatggattagttttattcctatacggattaaatttatctggaattaatcccgttattttcaccgacttttaaataacgacgtccaacgatctgaagacttaaaaagctggtattaattttaaatttactcgagggggagaattttatggtaaatgcatacaagaaattctggaataatttatttgatttttctggtaccgcaaaacgtgccgaatattggtggccagtaattattaactacatcatcggcggtttagcagttagtatcatcacaaatttaatgggacatcccatcgatgatatttataactggcaggacttgagcactaacgtagtggtacaaatcgttaccttaatcgtttgggtaggaaccttatcacttaagttccgtcgtttgcacgacacggatcgttccgggtggtgggtcttaattgacctaattccgctaattggaacgatctggttctttatcttgatgattttgccatctaagcctaaccgttgggatgggcaacgcgcataattgaacttcaatattctattttaaaaacgagacttagggaatttttccctgagtctcgttttagtttgttgaatatagcttaatctacaaaagtgatttgggctacccgtactactaggtgcgtgccgtaccggaaactgtcagcaagtatttttagctcatctgaactttgttgaaaatccacggattgcccattatccaaccaaacaatttgcttaatttttcgttggggcatctgcccttgaaagataatttcttgtgcctgttcgccacccagcaccacgttatggttcccgatgttctgcaagccagtaacaaacaaatagtcacctttaatgaagtttttatcgttattctcagcgatatacgttggatgagtttcgttagcggtggctgtgattgccgttccattaactcgcatccatttgccgaccaattcaagaagcgcctggcttggtaaatcaattgaaccgtcgaattgaggcccgatattaattagtaagttggctcctactttacgagattgacaaatttgttcaattaattggcgagcagccacataatctaaatcattttctgcgttgccccaatggcggttaagcgtcatcgaagtttctgcagcaaagtaccggccgtgctgctcatgtttgatattttgtggattaccacgctcaaaagttaggacatccacgacctcgccttgattaaccccctgctgttctaggcccgtgttattggtgatcattgcctgaggttgaagttggcgaatctcgctgtataactggtccgtctgccaatctgcatccggtttgtcccaattaccgtcaaaccaaaaaccaccaatttctccgtaattcgttgccaaaagtcgaattagctgccgtaactctgcaaggtatcccggaaagtccgcagtatatttaggattatgccaatcataggtggcaaagtacaaaaacggagcgattccttgtcggtggcattcatcaacaaagatcttaatgacatctgctttaaaaggcgtgtgcatgctgtcaaattcagaaattcccttagtgtcaaacagacaaaaaccgtcgtgatgcttggccgttaacacgatgtacttaaaaccattttgttttgccagggtaacccactgtcgaattttcttaggatcgggattgaaatgtgtaaaggcttgcgagtaatttggaacctctaaaatattttgcgcccattcaccttccgcaaagtgcgcatagagaccccagtgaataaataaccctaaacccatcttttcaaaatttaaaatcttgtcttctaccatcattaaatttacctcaataaaaattcccgttccagctgtcttgatagattaaccggtttaaaaatgtccttatagtttagttaatcgttgaaagcgagaacgggaacgtatttttattagcttattgaataactgcgttaaattcattttcaaactaattctgaagttcaattgcacctcaaattcaacctaaaacagcctcagttgcagttatccttaaagctgttgctttatttcttggagttccttattagtagtaatcagttcactaagtaagtccaggaagatttctgctgacatcatctgatcttccgcgtggatatatagcggattaaccgcgtctccttgccccgattgtgcaaagtcggataacaccttcaaatgcgctttttgagcaaccttcaactcgtctcgagcatcttttagcatcgtttcaattgccgaatagtctggatgttccgctcgcgaatcggtcaccgcttccatcagtaagcccttcgcctggcccgagtgactaattatttcaaaacaaatttcttctaaaccttccaaatcaaattccccgtttccatttaaaacttgtccgcatcgataaacttaaacttgtcccaaggctggatgaagtcaatcaacgcttgattattcggtacgattgtagcaaccacatttttaagctcatcagcattttccatcggttgcttaacgatgttcacctcggccttatactgtccaaaatcatcattaccaatcgttaccattcctcgggtcagttgatgcttcgcgttattaaccggaatattgacctgacgatacttcaacttaacaaaggtcgaccgaattgcgtagctgttaatatctccgcggttgaaatgtaaattatccaaaataatttgtttttctaactccgtagtccctggagtaaattggatcaagaactcgggcaactgttgatttagctttgccacttgggcaagttcttcatcactagcacaagcattgccaataattacatcatcaattaatttagtactgattaaatattgcacttgttcgacaattggccgcccccggtgaatttctagagttggcaatcccgcattgtagggatggggaccttgcgtggcaacgttggatgaaacaaatgctgccgttcgtaagcccatttctttatacttctgagttgtttgcaaaaagtattcggtatctaatccggtataacgttgcgggtaaaagttatggcacccaatcatttttgattttagtggtcggtaagtcaaaatgttcgcgacgttgccagtatcgttactaatattcacttcaatcgtaaggtcgtgctcatcataggtcatcaatgattccggcatcccgtcaaaactcatgtctaagcgtaaaatatcggctcctaggtctttaaaaaaggacaaatcatcgtagctaacgttcaatttttgaaacaaacctggatttacgtctaagctcacccacatctttcgttgcttagcgtgatggatcaccgttttaaaacgagcaatggtttcctctggatcgccttccaattcaattaagctcgtaaatagacactgataacctaaatcagccgctttatcaatgtacgtgacgcattctactgtgctttgtttacttgggtaaactgatatgccaaacatcacctagtcatctactttctctaatttaagttggtttttatcgtatgccttaaagaatggccaataaatcaccatcgaaatcaaaatattcactatacataagacgattgctcgccagtcaaatccggtcgccatccacgctccgatcgggcctggtaacgtccacggtgccactgcggtcgtgtacgcgaccatgtgcaatttcattgctaaataggtaaccgccgccattgccgttggtgcaagtacgaacggtaccgcaaaataagggttcataatgataggaatcccaaaaatcaacggttcgttgatgttaaaaatggccggaatgatggtgaccgcccccatcgttttactaaacttggccttactgaaaaatgccagtagaatcgctaaggaaagggtggctccggctccaccaacccaaacaaaccattggaaaaattgttccgtcataaagtgaactggtgcgccgccgtgcgcgattgcatcagtgttggcattgaggttagcgtaccaatatggatacagaatcggggtggcaataaccattccgtgcaccccgaagagccaaataatggtaatcaagaataccgggattaccgcagaaaggaaggtatcgtgaccaaagtagccgatcggcgagaaaatccaggtcaaaattccattaacgtccagcttcaaaatttcttttagaacgaacgacaccacgataattactaccccaggcattaatgcgctaaacgatttccccaccgcacttggtacgccctctggcattttgataattaaattctttttatagaagaaccgcactacttctactgaaaaaatggcacacaggattgcggtaaacagtccttgagctcccatatttgccaatggaaggtaagttcctggttccattccggctgtcttagcacttaaaacgtttggaacaattgctaaaataaaaaatgacatttcagctaagacggatgtagaaactgggtctaaatcataaaatttacataaactagaagtaatcgagaatacacaatagaccgccatcaaactgatggaatagtacattggaattgacaacatggatgcatagggttgaataaatgctttccaagcatcgattggtaaattcaataaaattgtaaagaacgagccaataattgaaacgggaataattacagccatcccgtcccggatcgcggttaagtagcggttgttggccaccgctcccattttctcggaaattgtatcaaagttcatggtcagcctccttattaactagttgaaacagttcctttgcctttgcaggagtgtacatcgtcattggaatcagcactaatttagcacccttttcttcagctaacccggcgatgtattttttcctaaacgaaacttggggcgcgaggaggacaatttgataatccttttcttgtaagtcgtcttcgacacggtcaatactagactcgttaacttcccaagtaactccgttgttttgggcttccttgctcaaagcctccgccaaaattgacgaactcatcccaccaccacacgctaataaaatgttcatgataaattcctcctttaaatttgaaacgtttcatttttagggtaaaaataaaatttactgctgaacaccaccaccttcttttgaatcgtttcattttcaccgaaataataacacgcccctctaaataacgcaagcgctttcaaaaacattttgcaaacttaattacctacttttatttgccaatccgtccttaaagccactagatctgcctaagtacgtaggctatttttacaataaatagtttcataattgccttccttacctttcaccaaacgttcgatcaatagtcgtcccgccgtctttccaatcgtggcgaccggttgttcaatcgagctaattgatggataaaaaatatcgttaacaaaaaagtggtcaaacactagcatttcaacgtgcctttttgaaaaatttcgtctcaaggcctttaaagcacctaatgacatataataattgatcacgaaaagcgcctcaatttccgggtgcttagtaagtaagcgggttgccccctccactcctgattgaatggtatagtttccttgccaaatatactgctgattaatgggtaagtcgtgttctcttagagcatcttcatatccgccctggcgttctcgggaaatgtaattccgaggttgccccgaaataatgccaattttttggtaaccgcggttaattaaatccaccacaccttcccgcgatgactcataattattaactaaaaccacgtcggattgaatcccgtgaatcggtgcgtcaattgctacaatcggcacggcttgttccaccactttctccaacattggagaactttcgtcctggtgaaagactacaattgcgtcaatcgagcggtttaacaggaactcgatcttttcttcaaaacgttgtttatcttctcggcaatcacagataataatgctatagccataattttccacgtagttttcaatttcggatacaatcgacattgaaaaaaagtcggtcaaactatttactacaatcccgattgacatacttttgttcttctttaacccacttgcaataatattttgatgataatcgagttcatccatggcttttttgattcgactagcagtcttgggctttaatcttttaccattcaaataatttgaaactgaacccaacgagactcctgcccgtaacgccacatctttaaccgtcgccatttcaatcctcctaaatcatctcgtactgtgatgtttttaagttgattgtatcaaattaccacccgctttgagatagatttgttgaattgtcttttagaactttgttagttttcaacgtcttctcttcaatttactaatcaccaacccgcataaaatttcacccgctaaattttttataactaatactttatttaataatttctgttatgatgaaggggttaaatcagaattagaggtcaaagatatggggtatatgtatttatcatttgccatcgttggtgaatcaattggagataatttattaaaggcgtcggccggttttacgcgtccagtttacggcatttctgcgttactttcgtatggaatttgcttttactttttctcgctctcgttaaaaacaattaacctaaacattgcgtatgcagtgtgggcaggcattggcattttgctaactgccgtgattgcgttccttttttggaaggaaccgatcaacctaggcaatattttaggaatcttcttcatcattgtgggggtcgtgattcttagtttttacggtgaaaattaagattaaatagaacgactcgcttaatttactagcttcaaagggcggtaggttccgcttaattcaaagagagtggaactaaagtcgggtagtttgcgagcattaactgaaaattgaccatgatgcctgaatttggcatgacggtcaatttttggttaagtggaaccaactgacttttggcacacgttttggctttattgaaggcaaaataccaaaacgactttttaagaatcttttcatccatgaaaagcatttatttagttttttcagcctctttttttaatttgccactctaatccttactaaattggtaaaattcgtccgccacttaaattatggctgaccatgttaaactagaaatggtaattaacgaaggaaattatccaaagttaaaaattattgtcggccgattaatgcaaagtgccggcatcatctaaaatagggagtgtactacatatgcttaaggaatttaaagaatttgtttcacgtggaaacgtccttgatttagccgttggggttatcatcgggggtgcttttacttcaatcgttaaggcgttggtcaactatttaattaacccattaattggccttttcgtgggaggaattgatttttcagactggtcattcaaggtggccggcgctacctttaaatttgggagcttcatcaacgccgtcattaactttttaattatcgccttcgtggtctttattatcgtaaaaaccgttaataagtttgtacctaagaaagctgaagaggaagaaaatactgatgaagttgataataatgaaatttatttaaaagaaatccgtgatgcgttggtcaaggaccccgacttacttgaacaagcccgtgagcagtctagctccagtgaaaagtaatccattactaacttaatttaaccttcataacgagactctgaaaattaccgggtctcgttttatattaccgtcaattcaggaatgctgaacttaaatttaagttcatttaactaactgaaagcgaccttaaaagcggtcgaaaaatgaagaacctcaatcgggtttttgggatataccaaaaatcaaacttttccctccacgtaaaagagcttaaatttattttttgacaaataagcgatatcacttgaatgtaagcgcattcttttgcacaatagaaccataacgaaaaaggagctgatttttttatggcataccaatctgtaaatccatatactggaaaattaattcaaacatatccaagcaccactgatcaagaggtcgaagttgctttaaaaaatgccgatgaattttaccaacttgccaaaactcaacctatcgaaaagcgagctgagaaactacaattaattgcagacaccttccgggagaatctcgatgactacgcccgtttaatcactaccaacatgggaatgcttttcaccgaagcacaagcagaggtaaaaaaaactattgagtttgcggaatactacgcccaaaacgccgctaaactattggaagataccccctacaatgacgttccgggcgttcgcgctcacgttaaataccagtccattggggcaattttattagttgagccttggaacttcccgtacacccaaatcatgcgcgtatttgctcctaatttcatggtgggaaaccccgttttattgaaggatcctagcataattccggactgttccgatgcctttgccacggttactcaaaaagccggcatccctaccggagctttcaaaaacttattgatcaactatgaccaagtcaacaccatcattgctgatccacgtgttcaaggagtcgctttaactggttcggaaggcgccggaaagaagattgcggccgaagctggcgcgaacctgaagaaatcgaccatggagctaggcggaactgacgtattcatcgttacggaagatgcggatcttgaccaggcaattaaagttggcgcaaaagcccggttaaccaacgctggacaagtttgcacttccgctaaacgattcattattaattcaaaagtttacgaccagttcttagacggactaatcgcggagtttgctaaacgaaaaattggtgatcctcaagatccgaaaacgactcttgcgccactttcttccaagtctgcccaagaaaaactacaaaaacaagttgatatggccatcgccggtggtgctgaattgctttggggagacaatacgccgtttgaagggcctggcgctagtttccacccgttgattcttagtggcgtgcaacccgacaatccgatgtatgatcaagagctctttggtccagttgcacaagtttataaagtcgacagtgacgaagaagcaattgagctcgcaaacgcctcacaacacggactaggcggtaccgtctttgctggcgatttagaccgtgctgaaaagctcgcttcccaaatcgaaactggtcaagtcgccattaaccaaatgctaacttcacacgcaagccttccgtttgggggcgtaaaactttcaggctacggacgggaattaagtgacctgggaattcgcgaatttgttaacgctaagacgattattgatggataaaaatcgttaaatcgtttattattaaaatgtaagcggattcataagttcgtttaaaattgtcggagttagtgaggaatgacgtatgttaaaagaattagttattaatgctggtagttcaactttgaaatggaaattattctccatgcctgatgagcaaatcttagcgagcggattggttgatcgaattgatttgcctgcctccgtttttactgctcaacaacccggtcaagaaaagtaccgcattacccaagataatattacctacgatttagcagctaccatggtgctttcgtacctaaaagatcaaggggtcgtggaacatcttcacgaaattagcggaattgggcatcgcgttgtcgctgggggtgagtattttaaagattctgtcttagtagacaatgaagttttggctcagattaaggaactctcccagtacgccccgctgcataaccccattgaggcgcgctatattgagattttcatgcagctattgcctaaagcgcgacaagtagccgttttcgacacttcattgtacgcagaaatgccaaaagtaaactacctttaccccattccttacgagtattacaccgagtacggtgtgcggaaatatggtgcgcacggaactagccaccgttacgttgcccaacgggctgccgaaatgctcggtcggccgttagaagacctaaaattaatcacctgccatttgggatccggttcgtcaatcaccgccttcgaccatggtcaggttatcgatacttcgatgggcttcactccgctaggcggggtaatgatggcgactcgagcaggcgatttggatgcttccctcgtggctttcttagctgagaaattagaaattagcgtagaagaagttgttggcatcctcaaccaaaaatcaggtttattaggcatctcccagctttctcccgaccaacgggatctggaagaagctgcacctaccaacccccaagcgcaactggctttagatatgttcattaatcgggttgtccgttttatcggaagctacgttgcagaacttggcggtttagacgtaattgtcttcaccgcgggttgcggagagaatgcgattgaagtacgccaaaaaattgctgaccaacttagttactttggtttggcagtcgacgcctcccgtaatgacgtccggggcaaagaacggaaaatcagccctgacaatgccgcggtagacgtgttagtcgttcctactaacgaagagttaatgattgtacgagacgttcaacgtttagcaaattaatctccctaaagtgtgacagcagaactgctggattggtttttgttacttcatttattaaaatttaagcctaaagaatcggaaaaactaaaaaaaattcttttccccgaagaaacttttttgaaaaaataattttggctttaatagcgtcaagacgtgcgccaaaagttagtttattccgttcaatcccaaatcgaccattatgcccaattcaggcatagtggtcgatttttagttacgccgtaaacttgttccacgctcttttggttttgtctaattataatttctttaatattccctattgactttcaatagtgttaacttcataatgtggcttaagcaatattatatgtcatatagtataaggaggagtaatgtggcaattcaaattcccaccgccttacttgatgggtgcgtacttggcattttaaaccatgccgattattacgggtacgccctaacccagaaagtccaagagcacatccccgtttccgaatccactatgtatcccgttttaaggcgactgaaaaaagctaatctacttaccacctacgatgaaccctatcaaggacggaatcgtcgctattatcaaatcactgctgaaggtcaagcgcagttaactgaagttcagcacgagtggctcacttttaaaaaccaaatcgaccaattacttggaggagttgaatcagatgcatgaatacatcgatgaactaaagtcccatttaaccgaactaactgcagaagaacagttagatgtaattaatttttataccgaataccttgcagacgccggaattgaaacgtatgccgcagccgttgataagctcggcacgccggtccagttggctaggaaagtgcttgctgattattcgatcaaggctagccaaaccatggacgacactggtgcgcaaacccaatctaagcaaccgcaacgtgacgtacgcaccatttggctgatcattttagcaatcctctcctttgctacgccagtgggtctgatcatccccgccatcctcatcaccatttgcgtggttccgttcagcattattttttcgatagtggttactattgctgccttctttttagggttactgctgatgggcgtaattttaattggggcgggtggttacataatcttcacttcattttgggcgggagtcttagttctcggaattggctttactgctttggggctgtttttattgcttctcccaatcttccactggcttacggtgaacggtatccacctcgtttcccaattattccagaaattatacaacttcctcaacgaaaaaaatcatttcggaaagagggtataaacccatgaaaaaaacttttatcgttggatttgcactaaccattcttggaatcatctttatcaccattgcttcgcttaacaacgctttttatgatgttcctcaaataaacgaacaaattcattttgttagtccgcattcagccactaaatcttatcgtcaggttcgttccattgaacttaaaaccccaaatgacattaaggttgaagcttatgatggcaagtcggtaaaggtgtccgcaccgacttccctaaatcaaatccattaccaatctggctcccagcgattaaccattgggacagcgggagtgaatcatttactaacttcacttctcaaccgttatgaccactctgaccccattttaattaaaattccgcggcaaaccacccttcgttcggtaaagggcagctccaccggcgaacttaatttttccgctttaaacgtcgaccaacttcgattacggggaactgatgaagttcatttaaacaacgtgaaggtcaacgggctcttaagcattagtggtgaagctgacctgaatttaaataacgtaacggctgacaacttgaatattaacaatgatggcgaagtagacattcaaaactccgactttcaaaagcagcctgcttcaattgctaacgccgacgatatttcaatcactaataccaaacttaatcgtgccaatttaacttcatcagatggtgatattaacttaaatgaacttcagattacgcacgaattgaccgcccgcacgagcgacggtgacatccatgccgttttaaattcagctaaaaaccttgccgtctccgccacagctaatgacggaaaaactacaatctttggtcactcccgacgccactttaccgatggtaatttagcaaccaattattcatttagcactaacgacggcgatatccatattgaataactttttaaccgattggagggtaaatataatgcaatcgatcattgaagtacaacatctaaacaaaaactattactatggtcagcattcccaattgaagcccgttttaagcaacgtgaatttgtcggtcgagtccggggagtttttaagcatcgtaggcccttctggaagtggtaaaactacgctaattaagtgtattgccggtttactatcaccctcaggaggaaccgttgcgattaacggcaccaatccttttcaacttagcccgcgcaaactagcccaatttcggcgatcaacggtgggcatgatttttcaacagtataacctagttccttacctttctccgtacgaaaacgccgtcctgccgctccggcttgcttgtaagcccattgaacgttctcgcgtaaccgctcttttatcaaaaatgaagttcaacggcaatttattcggcaacgttaccgatttacctggtggtgaacaacaaaaggtggccattgcgcgtgaaattcttgcaggagctagcgtagtttttgccgatgaacccaccggcgcacttgattccaaatcaggagcaattgtaatgcggcttttgcaaaaattagttcagcatggcaccaccctcgtaatggtcacccataacctagagctagccgctcaaagtgaccgggtaatcattttaaacgacggccgccttacgcatagtatttcaaatcccacggctacagatttaatttatcttcaggggggaacctcatcatgatgcgaattggcattaaggaatttcgctaccaatttaacaattggttaggcgctttagctgtatttattgcggctagtttagtaagttccagctgtttaattatttattttccgttggcacccgttgttcaccattctgaagtcaccaatgcgctctttattactccactgagttttggcctcgtaaccctctttgtggtaatcagtggcgtcattggaaccattggaaaagcgctcgctaaagaacacgtccaactggctcaactagggtctaaccccgcccaattagctcaaattaccgcggtacagatggttttagttagttcattaggaactttgataggctattttgtggcccttaccttagctcaagaaatgtaccacctcattcaaaacgaagcgggaaaagcttacatcccttccgttgtaatcaattaccagttaaattcgttctgcgcagtttggggacttaccttaatcattacctacgtttcaagttttctttatagttaccacactttagtgaaaatgaaaaataccaagcaacaccgctttttgaaaattctgaaaaccgtttttttcggcatcgtggttatgctaaccatctcagggatcctttgggagtactatcaaatctactttgctaccaacgatattaaacctaccgatactttccagctactattgttccttaccgtcgttttagtttggctggttggtaatcacttaatcaagctcagtctccgtttgatttactatggagtgcgtaaactaggtacgcggacgctaaataccgcgttttatcgagttaaccgccattcctcacgattaactaccctaattaaaccttttttaatcgcactgctactgctttcagggattcttcatttagttctggaattgcttaatatgcaacgcgtccgaagccttactggagtgttcctcgtgttactgatttattttggccccaccttgattatcgttgccggcaatatgatttccttaaccattatggaaagaaacattgcaaaacaagatttcacgcaattgagggttttaggttattcccccggtgatattttattggaacaaattcaggaaggagctctgtatagcttgacagttggctttttgatggcaatttttaacttactattctttgccgccatccgttttgtgaaaaaccgggtgtttgatgttgcctatttttcccttgactggatttccgttttatactggccaatcttagctagtacggcatgtttcatcctggtcttcttacttggtagtatccgagtaaaagctgcttgatcctaagctaagaagtgctaaaagttagtacttagcgcgcttaataaaaaggaaacgggacaacttcggacgatttgtaaacattaactaaaaatcgaccattatgataattattggcataatagtcgatttgggttttaagggggacaaattgacctttgcgcacgttttgaacctacttaaattcaacaccacgaaaccttttagagtccttgacgccattgcattactaattctggttgttgcgttgcttcatcaatttgccgcttaatagtttgaaaactatgactcaaatagaatcgaattgccgccggattttgctcatatactgccaaactaagttcagagtaatcgtgttggagctgcgtcactaaccggccgccaattccttgtccttgcacatcagcagacacaaaaatccccgccagatagttttcttgtagtcccgcaaagcctcgaatacagcgctcgtcctcagcaacgtaaaccgttgcctgccgcattgccgcctgcactgccccttgattttgcttccagtattggggatccacaaaatggtgcgcagataaatttccgtccaaccaaattgccataatttggtccaattgaacttcagtaatgttttttaaccgatgaattttaatttagatcgaccttctttcagaaaatttaaaagtaattaaggaatgctaaataattcagccttttgctcgtatttgttaactgaaggtgctatttttagagtcgaaggagttgatttagatgacatttgcaatttcgcgctttttttgggtcgcggccaccatttttaacgtaattttaggcgctattggcgcggtgttgccaatcatgcccggcactccctttttcattttagcattcttctgcttaaaaaaagcctctcccgagctgcatcaacgaatcgtacatactaaactaatggtatggttagaaactaagtttccgcttttagagcactggttgcactaaataattgatttgatcagctcaaacgaacttaaattgaacttcagaatttgtttaaaagacttgatttaacttaaaaagaaccgcccctaagaacagtactaggggcggttcttttttcaaaatgtaaaacatgtttgactttacatataaaaggtgttttactaaaaatgtaaaaagtattttacatttaataagggagcaataaccatggaaaacagcattactaggcaccgtaagcaccttaagctctctcaagctgaagttgctcagttagctggggttacgcggcaaacaattaacgccatcgaaaataacaaatatgatccatcactctccctagcttttgaactagcttatattttaaatactacagtagatcaattatttatgtattctcgggaggtagaccatgagtagaacacaacggttggtacactttgatttttggatgaataattttttgattcttcccctcctcattattagcttagcactaagtaatcttttacctggattagccacttttgctatcgccttcttaattaccacggtcggtggagccatccaacgccaccaccatcaatccatgggcgttaaatataatcagttcttctaccctggcgacgacgaacgtgaacaaaaattgtttatgcaatcttacgttcggtaacttcctggttcatcgccagctgctttattttattcctttccttactgttcattctgcttttcactctcagtgctaaaaccaccatcgcctttattggtacgggactcgccgtaatttttttaacggcgaatgcaatctactactttttatggtttaaatacgacccgcaataagtaaattaagcactgataacaaaagccggataatttatgggcaccaataaaaaaacgactattatgccaaattcaggcttaatagtcgtttttggattaagtaaaataaactgccttttgggtgcgcgttttggtcccttaaagacaacgcaccaagagattttccaaaaagaattcatccttagaaaaggattttttctctgcctcttagtttattatttacttatggtacgggctccccgattgaatcataaaagcacggtaaatttgttccgttagcaccaaccgcatcagctggtgtggcagggtgaaacgtccaaatgaaattgccgtgtcagctcgtttcattactgctgggcttaaacctagcgaaccgccaataacgaaggtgatgtctgaatgtccatacgtggttaatttcgcgatctcttcggccagctcttctgaagaacgctccttaccattaatctctagggtaaagacgtattcacgatctttaatcttagctaaaatacgttcgccttccttttccttaaccatttccatctgggcgtcacttaaactttcgggcgctttttcatccgggacttcaataatttgaaatttgcagaatttagaaagtcgtttggcgtattctgcaatcccctgtttcagatatttctcttttaactttcccacaccaataattttgatattcaccgtttatccacatcctatcctcaagttatccccaaagttttccacaggcattttgaaatactcacaatatattgggccgaatttatgttcgccaccacatttatttctttggatttgtcaacagcatttttacttatccacagttttccaccttcatttttaaaattttgttaccgctacaaacgttgtcacgacggcgttttttaccttaaaattcaatttttaatttttttatccacattttccaccgcaacctgtggaaaacttttctacaagtccaaaggtcggtttaatcagttttgtgcacaactttatttcctcttccaaagttatgaacaaagttatccacagttttccacacggaactacaactgtacttcaattgtccttccgcctaaatcgctatcattaatttttgaactaactttgaattcaccaaaactaatttacgttcttgcccaccttttactgccgtatagaaaactgggttccgccaccaaatatttttggcataatccagtttgcaagctaactacttattgaatttctactagcttcccaattgacaataaatacaggtacttttcgttaactggtttacccagaatattacttaatgcttgcgcatataggttaacctgaccctggtaccgatcaatcactttttgaatcccttgctgcgggctgcctgggagtacaaagtcggttttgtagtccagcagaattactcggccatctaattcgaagtacgcatcaataattccgtgaattaaaacgtcctgattgccaactacattaggaaatagcccttttgccggcaacagcaatgagaacgcctcttcacggtgcacttgttcaggatgagccaacattaattgtcctagttcactttcgaagaagtctaagatgctgttgattcgaattcgcttcgctacggcttcttctaatacctgattcatcactaactcacgaattttatccttgattactgcctcagtaaccggttctcgcaaatcaagctgctgcaaaatcaagtgggtcgccgttccgatctcagttggtttgggttggctaacttcgctcataaagcgaggcgtcatcaattgatcggtgacaaatcgtttctgcggacgaattttttggtcgcggtcgaccgcactaaagtccatctctaatttgtccggatcgtcaaaaacccgtttaatttccgatacggactggtaggccgtcgtttgggttgcttcaatatcgtgatatttgaagttcagaattgcccgaatttgttctgcatcattaatgtcgctattcacgtccactttttctaacgttggtggcggtccttgctcaattcccgtgtcagaacgctgcccagccagtaaatcagcgcggttaacgaccttcaatttaacttcaactcccgcggcagagtccaattttcgtgaactaacatcgggataatcttccgtaacggatggcacccgcataatcgccattccaatccaatcaagaaagtttttcgcctttcctcgctcagcttctggcaacagcagctcacccgtgtcagctgcctgagcccacttttctagcgttggggtagcagcctttagcgctccggtaatgattaacttttgttgtgcacgggttagagcaacgtagagcacccggagctcttcggcgagcattttacgttgccgtacgtcaataatccagtttttttgcatcgtgtcgacttctaagcggtgcacaaagtccttcacggtaattcccatccccgcatcacgatccaacacgtagcggcccttagtgtcgctattattaaacccgtgatccgcatcgatcaggaacacgattggaaactctaatcccttactactatggatggtcattaattttacggcttccgtatcggtaactaccggattttctgccaaatctttattcttttcgcgcattttctctacaaaacgcacgaattgaaataaccctttaaaactggactcttcatagctctgggcccggtcatataaagcatgaaggttattttgccgttgcggtccgtccggcattccgccaacgtaatccaagtacccggtctcttggtaaatctcccaaagcaaatctaccagcgtgcattgttgggaaagcttccgaaaatgctgtaattgatctaagaactggtcaattttacgttttaagttggcttggaattcattttggtaatcaatcttaaactcattttggaaatacaataccgactcaaaataatgcccgttctttttagaaatccgcaaaaaggccagctcgttttcatcaaggccaacaattggcgaacgtaaaacggccgctaatgggatgtcctggtacggattatcaataatcttcaagagggccatcatgatcgaaacttcggtcgtttggaaatagtcttgggcattgctaacttcaattgggataccgtactttttgaaggtgtccacgatgttaagattgttattccccgtcgaatgcagcaatgcaatatcactatatttcaaaggccgcatttcctgcgtatcccgatcgaaaacttcggtttgatccgcaaatagccgcttaattcgttgcgcaatcatttgcaactgtccgtcgtttttatcggtgattatcgccccaggttcttggtcagccgtattttcgttttgctgatcgtcaaataatagaacttccgtgtcattctgaacttcagcggggtaatatttcgcgccgaacttcagctgggcatccgcgtcgtaggtaatttctcccaccgcctggtccatgatttggttaaaaaccaagttggtaaaatcatcaacgttttgcatagaacggaaattttccgccagaataatccgttcgtctggttgcccagattgtttaaatcgccggcttttactaatgaataagctggggtctgccattcggaaggcgtaaattgactgtttaacgtcccccaccatgaacatgtttccaggatcttcacgagccaccgccgtcaaaatggtctcctgaagcgggttaatatcttggtattcatcgacaattacttcgttaaatttctcctggaaatttcgccgaactgcctgaccctcttcggactggttttgcaaaatttgtaacgcaaagtgctctaggtcactaaaatccagggaacgccgcgttagcttttcctgtaaaaagcggtcggaaaattgctgctgaacttcaattaacttcagcattaactcccgcgcgtccttaaaaatggcgattaactggtcattttttagtttaaagtaacgctctactaatccgttaaattcagctttaaattcgttgcgtaacggcttagcttctaaattaaactcttgaacttcaggctttttcccacgcggtagctgagcaaacttaaagttaaccattgcctgttgcaaggcatcccagttaggctgatcaaattgatcaatcacggtttttaaaccggctacttccgcttggaaattagcggccgctttttgcaaaggctcgccgccgttaattgcacgttcggtaaggttaaggtccgtttgataaatttgaatcagctgcgtttttatctttgcgaggatttgtttcacaaaatccatttccattacctgatcagtttgtacttcataattattggcaattttagttagccacgcttcaggatccgggttggcgttcgcaaattcgaacaagtccaacattaactcctggagaccagcatccgaacggtcgttagaaaaattgcgcgttaagcgtgcaaattggccatcctcatcactttcgtacagttcctcccgtaagtcggcccacacctgttccttcaataactcgctttccgtaggatccatgatgcgaaaggctggatctaagtcgattacgtagtagtagttgcgtatcaccgccatacagaaagcgtgcaaagtactaatattagcgttatttaacttgccgagctgtaacgaaaggtggttttgtaagtcagcatccttaacctcactaatttttttcataattgccgctcggatccgttccttcatttcagcagcggctgcttcagtgaaggtcacgaccaggagacgatccacgtcttctccgttgataatcttttgaattacccgttcaactaaaaccgaggtctttcccgatccagcggaggccgaaactaaaatattatgccccgaactatcaattgcttgttgttgactaggcgtgtaagttctagttgccattcttcttgcgttcctcctcaatcttccttaagaccgtttctttatcgagtttttctaagacccggtaattattttccggtagcattgcgtcaaattgcataatttctttatatggtgaatattccagcgcggtcgtccggtctggccattgtaccgggttcaaatcgacttcaccactaaagattcgttttccagcttcaatgaccttctcttcggcatgtttaattaaatcctgaagttcagtttcactgacgacgttgtttaagctagccttggttaggctaccgctcttagtgaaatcaaacgggtacactgccgatttaccagtttcagcgaccgttttatcaatttctttcaacagttcttcgttgttcaacacgaacccgtttaaagaaaactttttgaagagcgcctgttgcaattgatcttcgtcttgcaccttcaaatcggtagcctttaataacggatcttggaaaatcatgtatagcgcgcttgatagtcgtgcttgttcgtgaggaacaatccgttgccgattttgctgcacaacgtctaaatataacaacatctgcattgccagcccgtaataagcatcggcaaagtcgaacttacgcgtgctcgacttgtaatcgaccactcctaaatatggttgaccttcaatattaattttgtcgatgcggtcgattttaccgcggacgttaacttcctgttttccattaactttgaagttcagcgcaggtaagccttccttcaagccaatttggccaaacatttgctctgaagcaattggccgcattctggtctgagctaattgtttaaaaatcgccgtaaccatcgtttccaccgtacgatctaactgctttctcaagtaacccattcggtaggtgctattaaattgatcaaactgcgaatcttggcgcatgttttctaaaactcgtttggtaacctgttttatctgtgtttgattaacttcattgaagttcagatccgcttgagtaattacttttactaggttatccatcgcagcgtggaagtactgcccggtatccgccgggcttaaatccgccgtttcccgttcttgcagtttcaaaccgtacttcaagaagtatgaatattcattgcggaaaaattcttcgagcttcgaaaccgaagcgtaaattttatcaccatataactgcgtgacgatgtccggttttaacttgcgagggacgttcttataacttaaactccccatcagtcgttcggttaaatcatgccagcggccagcctctaagatgctgtaaattaaattccaccgcacgtcggccggttgcttactttccttcatggaacgagcgtactgaactaaatggctcagcgtactccgttttgaaccgataaacggttgaataagcggttggtccacggccggacgactaggcaaacattgaacttcaatttcaaagtaagccttaattcgttccacgtaaggcgacaatttaaagtcagttccgtcattgccccgttttggataggtaaagattaacctttgagaaccaatcataaaggttaggtagtttaaataaggttcctgacgcatttgtcgctcgttactcatcttaaggaattggtcatctgcaagctggtcactaacttgcgccttaccttcctgactcaaaaaatcattatcctgaatttgttccggcatggcccggtcggttgcgccaatgatgaagaccaccttccgatccatcatttgcaccatgccgctttctgaaataagcacctgatccaaagtagatgggatttgagagtaggtcgcattttcaaagccagcatttaataaaccgatgaaattattggaatcaaacggctggtcacctaaaatgtccacaaattcgtccagcatcgtcacaaacgtttcccaagtctgctctggttcagcagccttggccaagttaccgtcttcaatccattggtcgcgccaggccagcaaccgctggtccacgtggttacgaattaaaaactggtacaatgccttggccgcctccgcgccattttcagctaccgccaactggttgaaaaacgggttgaccgttttaactacgtaatccttaatctcgttaatccgtcggttaatttcacgttcctcgtcggtttgctgctccatatcaacgtcattgaaacgttggtattgccacggagctttttgcagccacttacttccgtaaatcccctggcgcagcacgtagttttccgtaatttggacgcttttgacaaaatcctttccgtctgggtcggcgtcgttttcaggacggagaaggccagttttcagcaagcgcattacgtcttcgtaacgaaaatgccgcttttgaacgtcgaacaacgcgttaatcagttctagtaggggatggtttttcatcgccacttgcatatcgtaaaaaatcgggatatcaaactgatcgaaaattggcttaataattgtgtcgtagtcgctcaaatgacgagttaacactgaaaaatcggagaaatttagccgatcatccttcgtcatcatttggcgaattgccgtggctacgtgctctacttcggcataccgactattaaattcgagcacctccacactgttattttgttcatgtctattctgaccaagctgtccctgcgtagatgcaacccagtagcgctctagctttcttaggtcgtcatttacccgttttttagtcaccactcgtggagaagccacttgaattctgttttcacgagcccattcatttattttgaaaaatattttttcattttcaaaaaacaagctattttctgaaagtttttcatttagtggattacgctccattactaagtcaattacgacggtcgcgttcgccttaatcaacgtctgaattaaattaagctcttccgcagtaaaattagaaaaaccgctaatcacaaagctttgtgcatgtaaatccattttggctaactggtcggttaatgcacgcaagatatcactgctatcgacaaacttttgttgaattgcttcgtcataagccgtatagatgatgtttaaatcatgcaacttagccatcaagtctaactggggatcttcattttcggctagttgatcaatgatttgacttaaattttcagggcttacgtttccttgtttaaattctgccaattggctagtgatttcttgaattaaaccaagttgtgcatcaatgttatggaataataatagttcatcctgatgctccgcgataattcggtagagtaacatactggtacttgaattagtcaaacggggatattggtaaatgctactattacgtaagaaaaaccacgctaatcggctaatcgataaaatttgaatatccttttgcgcaaaaactgggcccgctgaatcgcttttttcgcggagtttttgcaacaattgaatttcagattggaacttaatgtggttaggtaccaaatagtaaattttacgttgcttttgttgtcgctgaagttcaattattgtttcagcaaccgcatctaaatggtcgacgctggccggcccgtacataaatttaagtggcataattcctccttaattgggattggagatccctacggattgattttggtattcttctgttaaaattgcttgcttaacgagcttggtaactgcccgctcactaactacggcagtgggaatcggttgtccttccggagtaatttcagcaccttgattttgaacttcagatttaacttcaactggtcgaatgatggtgtacggcagctctgtttcatcaactagcttagccacgtacttgacctccagcattagttcccttacgtcctgaacttcaatccaagtgggatcaatttcgttatccattccagcggttgctaaaaaaacaattttattaacttgtaattgttgttcttctagccggtccaccaccgtttcaaactcctcgtccatccccaaatgaagcaggtctacgtataatacgtcgtagctgcccatcgcctcttgaacttcagcaatagtcaccttcacttctggcaaagtatttagctccgccaccactacatcagagaccgggcgatccatcccgattgctaatatcttcattgtattctcctttaaaacgtctttttaccattatagaacggattcatcctttctccaattttatcgattattgaagcttttgtacgctccccgcgtgatcgtgagttgttgaaatattttttatgtgttaaaatttcagacaaattaaatggacccaagcctatataatgtcttaatctggttgacagtttctacccaacgccgtaaatgttggactataggaatttttaacttacatattcatcaaaatggctggagaatgagctagtccgtttgctttgtcgtgccaataatcgggccacttctaagatacggtgggggaacgataaatcttggtgacggtgtggtaaactgctaaccctcatgtcccagctttttttaattgtagtttggcgccttccagactatttataggctcgctttcataacttttgaaaatatatgaaaacgaggaatgtgctttatgaaaactaatgattcgtatgctgacgcaccaattaccgaaatcaccccgcaactaaccgagggtaaagcagcggtacttggttttcagcacctcttggcgatgtattccggtgacgtaatcgtccccctccttatcgggggctttttacattttaccgccgcccaaatgacctatttggtgtccatcgacattttcatgtgtggcattgccacccttttgcaaattagaaccacgccgctcaccggaattggcctacctgtcgtgctaggttgcgcaattcaatcggtccaacctctagagcggattggcggtggactagggattacggcaatgtatggggcaattatcgcgtcgggactctttgttattttggttgccggactcttttctaaaattaggggactttttccgccaatcgtaactggttccatcatcaccgtaattgggtttaccttaattcccgtggcatttgaagacatcgggggtggaaatcccgctgcgcaatcatacggcgaccccaaaaatctattagtcggtttggttaccgttgcagtaattgtcctcatcaacgtttgggcgcgcggtttcatgcgttccattgccgtgttaattgggattctcgttggaactggcatcgccgctttgttaggaatggtatcatttacccccgttttacaagccagctggtttcattttccccgccccttttactttggggtgccgacttttaacctctcagcgattttaacgatgattatggtgaccctcaccacgatgattgaatccaccggggtattcttcgccctcggtgatttagttggtaaagaaatcacccaaaccgatttaaaacggggatatcgcgcggaaggcgttgctgccattttaggcggaattttcaataccttcccgtattccaccttttctgaaaacgtaggggttttgcaactttccggtgttaaaagtcgcaaaccgctttattacgctgctggatttctaatcctcttaggactcctcccaaaggccggcgccatggccaccattattccttctagcgtcctgggaggcgctatgctagtaatgttcggcattgtcggcatccaaggcgtccgaattctccaaaaggtgaacttcaatcaaactaaagatatcctaatcagtgcattatccattggaatggggttggggtcaaccgtagatccgcaaatctaccgagccctccctcaagcttgccagatgctcttaactaacggcatcgtggtggctagcatcaccgccgtggtccttaacctattattcaacggctacgattcttctcgttaattgttccatcagtaactgtgctaaaattaagttaaatgaagttaatgtcagtgaatgaaacgaccgacccgcctactttaatggcgcatcgaccttcgcttttgcgatgtcgcttcgttcttggcatttttcttttaggatggagatttatgatggaaaataattttatttgtacatgggctcgggacgcttccccactgatgcaagcttaccacgctaacaaatggggccgagtttctcacgacgaccgttacatgtttgaaatgctctcactagaaggctatcaagctgggctcagctggaatacaatccttaacaaacgggctgccttcaaagaatccttcgctaactttgaggtcgctaaggttgcccaaatgacggatgctgacgtggaaaagcttatgcaaaatccagctattttacggcatcgcggtaaattaaaagccaccattacgaacgcccaggcctttatgcaggtccaggcggagtttggcagctttgataaatatatttggcaatttgttaatggccggcaaatcaacgaccacatccgcattccggaagaaatccacgcgcaaaccccgctttcagcaaaaatttctgcaaatttaaaacagcgcgggtttaaatttgtggggccggtaatcatttactcattcatgcaagcaatcggcttgatcaacgatcatgaaattgaatgcatgtataaccccggctaaggagggctctgctaatggaaagactaattcccacgtccgcaaacggcaccattcccaatctttattttattggccggtgggttcctaaaaagttggcaaatcggtcggtgatgtacaccaccaacttaggtgctcaagttacttttgaagttcaaaatgctgcgagcgtgggcttggagtggatacttccagacctcgccatcccgcaaaccgtcacaatttttgttgacgatcagcctcgattgattgaacttaacgagccccgcttcgaacttcaattaagttcaaaatcccgacacgtcgtgcacctttatttcactggtaataccgaccaagacgaggtttggacttcttcagcaggtttagcgctcgccgatgtccatccttctgtaggtggtcaaatgcacgcagttaaacctgccgggcccttggttgcttggattggcgattccatcacggcgggatgttgggtacgtgaaaaagttccttctcgcggatatggcgccgacctcaactacgcagcgctactttcccgtaaattaaattgggaagactatcgggttgcttacagtgcagccggaattattcgttacggcacgggcggggttcctgccgcgccccgttttattaactacgtagattacgaaactccggcacctgattttcaacctaaatttgtttttgttaacttaggcaccaacgactggcaattcgatactccagtatttgaaatgtacttcactgcctttatgaaggaagttcaatttaagttcaatgaagctcaaattttcgtgatgattccgttaaaccagagccatgctaaaacaatcaaagccatcgcacagacgtttaatttcaccgtaattccgaccgttacttggaaatattcaactacggatgaagttcatcccgacgtggccggatcgcaagttctcagtcgccaactgttggactggctacagattcacggctgggtttaatcagagcttgccttacttcgctttaacccaatcccggtgaaaccactcaagattgagaaaacgggcgacataaggctaaaaaaggcaaatggcaagtagtctaacgtggctacgtggaacgtatttgccgcaaacgtcgccgccacgccccaaggtacgaggtagttaatgacggttcccccgtcttccaaagtccggcttagcgctacgtttgctaagccggcttttttaaaggtcgctttgaaggcttttcctggcagaattaccgataaaaactgctctccaatcaagaggttggctcccatcgcactaagaaccactgctaaaatcaatttgccgtcactatttagtactcgcgcaattggttccatgacctggttgatcaatcctaaatgaacgagcacgccgcctagtgacaaggtcaccacaatcaaggagacggtggtcatcatgctggcaatcccgccccgacttagtaattgatccacctctaggttaccagtgtgagcaacgtagccagtttcaataattttagctaagtgctgcacggaagtagccggatgttcgagccaaattaaacctaccgacaccccaatgttgatgaacagggtgggaactgccggaactcggcgccaagcgcaaacaaacattaaaataattggaattaaaacccaccagccggttgcaaaatgggcctgtaaaactgattcagtatgctgaattttgctaatgtcagcattttgggcgtcccctgcaccaaaaatagcaaataagattaacgctcccacaaaggctggcaacgttgaccacattaagttgcgaatatgatcaaataaatcggcatcgactaccgccgcagagaggttagttgattcagaaagcggcgagcacttgtcgccaaaaaccgctccggaaatgattgctccagcaactaacgctgggttaatacccatcgtcatccccattccaaaaaacgcgatccccacggtcgacatcaccgtaaacgccgatccgacggcagtccccaccaatgcgcagactacgaagacggaagggatgaaccagtttacactgatcattttaaaacctacgagcatcaacgttgggataatgccggccgcaatccaaacgctgattaacgctcctacaaggataaagatgaaaatcgggataatcccggtttcgatccccgatttaattccatcgttaatcgattgccagctaaacccccgtattttagcccaaatcgttaataatcctaatactaagagtaccggtgtttggggtgacaacccccacttaatcacgccggttcctaaaattgccaacatgacaatcaaaactaaacttgcttcccgtgtctttaccttttgcatcctcttcctccttaatttagctaataaaaaatcccggttgtatttaaaatacaaccgggacgaattaaccgtggtaccacccaaattagaccctccctaggggacagtctcactcactagatgataacggttctagttattagccgttcttaacaaaactattccacggtatttcgccgcaataatcctgatcggttcgcagcaaccaccgacttcctgacacccagattatccgctacttaatgtgaaagttattgcgctttaatttattgtagctagcctatcatgtccattttcaaacgtcaaatcccaacctttataaaatcggagacaggagccgtgaaaaagtttgtttgaacttcagccagcgtgattggcggttaaagatacccaccgtttgcaaactagaattttcaatgtcctttaagaatatttcttctaattggtgagcaatattttcgtcgtacatgaaggcgttaacttcaaaattaagtttaaaacttcgaaaatctaaatttgcggagcccactgacgatacctttccgtcaaccaccatcgttttcgcgtgtagaaaaccgttattgtagtaataaaccttgatcccccactttgcgcattgccaagcgtagtactgggtcgcgcggtacacaaagacgtggtcaggtttgcacggcaccataatgcgcacgtcaattcccgaatttgccgccaatcgcaaggcatccaatacgctgtcatccgggattaagtatggcgattgaatccaaatcgacttcttcgccgcgttaatcatcttcaagtaacccatcttaatcttttcaatgtctgaatccggcccgctagacacaatttgtaaactggtatgccccttaacctccgcaaccgggaagtaaaccgaacctggtttaaattcttcacttatcggatgcgcgcggtcggtagcgttccagtctaaaataaagcgcgattgaagactataaactcccgaaccgacaattttcaaatgggtatcccgccaataaccaaatttttctttacgccctaaatactggtcgccaacgttaaagccaccgacatagccgattttgccgtcaatcaccacgatttttcggtgatctctgaagttcaatcgaaagtcggttaacgctgaacgcgtccccaaaaagggaaaggcctgtccgccaagctcgtttaacttcttaaagaaactccgcttggtacccatcgaaccccacgagtcccaaagcacctttacttccacgccttctttagccttttgttctaacaactttcgcaaatcatttccgatttggtcgtcataaattgtataaaactcaacgtgaatatgtttttgggcttttttaatttccgcaaacatgtcctcaaacaatgcgtgtccgtcagtgatgattttgacgttattacggcgagtcaaaaacgcgtaatccgtccgcgaaaagaactgtaccattcctgctgaatctttaaccacttgatcagcagctgttaaagtcgtttcctttaactccttacgttgatgttccataatttggtctaattctaagcgggttttgctttttaacggaaataatttattttccggcagcttgcgaccgacaaaggcgtaaataacgaatccaaataatggcaaaaaacatagtaccaatagccaggcccaagtcgcggcaatatcccgacgttgtctaaaaaccgtatataaagctcccgccacgtttagtattaaaatcccatcaacaatccattttaaaatctgcaatgccatccccccatattaatcctatgccttatcatactatctcctttggaaaataaaagtgattttttatattaccccattgattatttcatatgtaatcaaatatccgacaaaatgtaatctcgtagcaatcaaaaattcacaatttcttcacattttacttctatagtactaagcatagataactttttcatttactccccccataaggtgaatgaagggtctcaagaccagttacttattacctgtatgcgtctccttagtgagacgctttttttgtgtttaaaaacaggcagaccaatttttgcttaattctctagcaactggtctgcctgtttttatttatactgattaatcttttggcagttaatccattcctttaaattgggggcgtttattaggaattaaatactgcgctggtaccggcttacgctgcggatcttcgctccaataccgggggattaaatgaatatgacaatgaaaaacactttgtcccgcggccgctccggaattaatagtcacgttgtagccgtccgggtggtatttctcatctagaatcgctttgttttgttcaattaaatcccagatggccatccgctcttcggtagtgacatcccaaatttgacggacgtgccgttttggaatgatcaacgtgtggcccttacttactgggtaaaaatccagaaaggaagcagccagttcattttccacaatgtaatctgcctccgttttttggcaaaatacacagtttgggtcggttttcatatgcggtccctccattcagtcccattgtacacaaaaagcaggttaaaaggggactttcaacctgctttaagttattcaacagctaaatcgttgatattctttttcgctttttcatcatgactccagaacggcaccttcacgacgcccatcaccttcgacttctttacaaatccccaataacggctgtcgttagaaacgctacggtggtcacctaaaacaaagtaggaatcctttggaacctttaccggattttttgcccaaccatatttattagcaattgagctgagcgtccaatttcccgttccggttgtgcgttgttcctcgtcaataaacttttgcggaacttctttattatttacgtaaagcttaccgtctttataactgatcgtgtcgcctggaaccccaatcacccgctttacgtaatcaactggttgagtagccgccggatcctctccgtgggcgtcaaacacaattacgctcatgcgtttgattttggcttgtttccaaactagcacccgttcgctatcctgtaagttaggttgcattgacgaaccgtcaacctttacgatttggaacaagtaagttttaacaagaaaagcaattaataaaccaactacgatcggtaaaacccaatcccttaaaaacctcattaactctcctccagactatctcatacgacttaataattttaattgtagcccaaagtatcctggttgtcttaagatttttagttttgaaaccaaattttgatatttctatatctttttgaaatataactgttatattcgggtatttttaacttaaattgaaattcaaaatttgcttaaatagttaaatctgaacttcaatcacacttcgtcaaagtcaatgtctaagtcctgccctaacgcgacatcctcttcttttaggtactggtgatccagcattttcacgaatgggtaatagataataatccctaaaataatctccactagttgtagtagggacccggtccagcttccggtagcgagccagcccgaaataattggcggtgtcgtccatggcagtaaaaccccgttagtccgtggcacccatccgagggcgaataccactcccgagatgaaggtgttcaataccggcacgatgataaatggaattgcgataatcgggtttaaaactacttgcagaccaaaaataatcggttcgttaattccaaacactcctggtagaatcgccaatttgcctaactcccgaatccgtttggaacggcaaaccgcaaacataacgatcaaaagcgacaaggtgcttccgccgcctccgtaggtcgtaaaaatatcaataaagggttgcgtataaatgtgtgggagcggaaggtggttttggaaagccttcaaattgtcctgggtaaggacaaagaaaatcggtgaccaaaccgaattagtaatggttggtccgttaatcccaaatacccaaagcaaactcgctaagaagttgtatagcaatactgatggcaacgagtttcctacgtgcttaagcggtgcttgtaacaaggtataaataaaattatatgcggtatcgaaactagaaatactaaaaccgatccgaattaagaaaaatagcaaaattactaacacactcggaattaacgcatcaaacgattgacttactgctggcggaactccctcaggcattttaattgtccagtggtgcttcacggcaaaccggtaaacttccacactgacaatcgaaatgaaaatccctaggaaaattccgttaggtcctacgtacatggtttgtaccgcgcttaccgccgttttaccaaccgtaaacgaagtcggggtcaaaatgaggaatgaaaccaaggcaactaccgcggaatggatggcctcgagcccccggttctttccataagcgtaaccaatgcccatacaggataaaattccggtgaagctaaataccgaattggaaaccgcgctaaaccattctgtccagtgttcgcctaaaatccttgtccaaaaactttcccagcctggaatgggaaagttgccgattagcaggaaaatggaggtaacgatgattaatggcgtgatgattaagaatccatcccgcaaagactttaaaaccacgttgtttcccaacttagatgctaacggcattaatacttgttcaaatttcttctgcatatcttccaagccccctttgcttttaaatttagtaacagtactggttcttaaaggcggttaaatcttcgcgattagccgccagtacgcacccttctacaaggtgatcaattgccgccgacaatcccgtaccaccctttttaggcattttcacgattagcaactgatccttatactgctcaataatggccgcgttcttttccaatgccgtcgcttgtagtgcgggaatcttagtatccttttgaaacgccgcggtcaattcgcaagccatttgcgaaaattctgggtaatcgtaagtcggtccaattataaccacatcggcggccatcttagcggccattttggtgaacttttcctgaactagttccggatgttcccggtaataatccgttccacaatagaaagtaccgatgacttctccgtctacctttgccaaagctttcgcggtggtttctgcgcttcccaatgcaacttttttgccgcctaatggggtgtcagcgcgttccttaccacctagtcccgcttgaatttggtctaaaataatgatgactttcaaaaaatcccctcctttgatttatttaatgggtgccttaattcgtttttcataagcgtccaaccatccttgcgtaatgggttcaatccgggtcgtttggttttcggcgggatgggcaattagaatctggggtgcactagttgccgtagctacactgaaggtaaattcgacgttggtagctactccccactcgccgttcttattcaacgctactaatgagaattcacccgccttgccataacggcgctttagtttttcaacgaacgggttcaccgcgtgatcacaggcgtcctgtggcgtttcgccttctgccattcgtcgaacgatttcataggaaatgcatcccttcatgatgtcttcacccaatccagttgctgcagcaccaccgatttcactgtcaacgtaaaaaccggaccccgaaagcggtgaatcgccaacccgtcccgcttttttcataaataacccggatgtggaagtggctgctgccatggaaccactttgcgcaagcgtgagggcgccaatcgtatcgtgcccgtcgtatgggctaatttgggcctcttgaatttcctttaaacgtttttgccaacgaagcttcgcccggtcggttagcatgttacgcatttcaaacccgttcaccaatgcatactttgtggcgccctcaccgacccgaaagctattgaaatgttcatgacttagttgccgagccaccgaaaccgcgtggaggacgtggtgaatgcctcctaccgcgccctgggctagggtgtcaccatccataaaggcggcgtccatttcgaccactccttcttcgtttggcaacccgccgtagcccaccgatttatagtagggatattcttcgaccacgttgattaaactttcaacggcatctcccgcacttgcattttctttcagcatttcactggctttcaaaactccgtcgtgtgccattcgccaggtggcaatcgttgcccaatttgtcatttcttttcctccatttttgctaaacctaccatggcattcatgtaaatctccatgtttaacttcaaatcatgattggtcatccactcgtcttgtttatgtgcaatccctttttgcccggggaacgatggcccaaaagcaataatgttaggtaccgcccgggcgtaggtcgctcccgtcgtggttacgggagttccatcttgcccggtaaccattgcgtaaactgccgatagttgttttattcgcgggtcatttttatcatgcatagttccgggtatccgccgaaccacccgaagctcacttcccggaagaactgcttttttaagtcccgcagtaacctgttcttcggtaacggtcaccggataacggatcgcaatccttaacttcaagccaccttcaactttttggaggaggtagggcgtgaccatcaatttgccactatcttcgtcttgaaaatctatccctagcccctcgccaaagtaacgttggtcaaaactatcgaggagccaatcaaagtacgtaaccaattcgggggctagttcagcccgcttcttgatcgccttggctagaagcatgatggcgttcacccccagctctggagcgttagaagggctgcgtttcccctgaacttcaaccaattgattttgaacttcaattgcaagttggtcggggacgtgatcttttgcttggtcacccgtgatggtcgaaatttgctgtaatgctgccaacttaattggggtatcgatttcataattaacaattccacgctcgccatagactgctggaaatttacaatcaggagtaaatccaaattcgggtgctggttgttcctttagataaagggggatgtccgcactcccgctttcctcatcgctaccaaaaatgattcgcaaagttttccggggataaaatccgcgttctttaagtaaatgcatcccaaacagcaccgccatgatgggccccttattatctaagacaccccggccatacaagatgtcttcccgaatatttaacttaaagggatcgctttgccagccttcaccagctgcgaccacgtctaggtggccaacgattcctatgtagtcgcttgtgtcgggaccccactgtgctaccgcaacggcatcattgacaatgcttgttttaaacccgtactggtcggctaacttcacggccacccttaatacttggcgaggacctttcccaaagggtgcgtgaagatcagctggcccacggacactttgaacttcaatcacctttgctaaatcacgtaaaaattcatcgtaatgtgcttcaatcagtgctttaaactcttggttaaccaccattattttcctccttgttccaaacgggtcagggtcgttttaaaggtgtacttatcggcccggtaataagacgtgtcgtagaaaattggttgcccatctgccgtgtaggtaagcgaatggacgcaaagaatgggatctccctcctgaacatgcagtaacttcgctagcttttcgtcgaccttaatggcctcgatttcttggttggaataggcaatttcaaccgtttctgccaagatttgaaacaatgaatgcttaaaatcgtttttttgatgattggctacgtacttatgtaaaattacgatgtcttcgatagtcatcggatcatcgtcccaaaaacgtaggcgaactagttcatcaacttcaggttgcggattattacgcaagtttaatttttcttccatccgctggtctggttgagtcaacggttggtaatcaaggacctgcgttcgactttgtttgccataagtttcggcagcttccgtaaaactttgtagacccatccggccgctttcaaccttattggacgaattcgtcgacataatgtaagttccctttcccggatccttcaccaaaattttggcggtcaccagccgttcaattgccttccgcaccgtcagccggctcaccccgtattcgtcagcaagttgatattctgaaggtaaccgctgcatattagaataaattccctgctgaatccgttccacaaggctttgcgccactttttcaaactttgtttttggcattcttttgctcctcatcgcaaatcatccattttgatttacggtatatactacattgtgtttaccatatttgcaagcgctttctgaaaattggtatatttatttcctgtattatttttcattctccacacaaaaaaacggcttacttaaccatcaaatttcttcattggttaagaagccgttgaacttaatttgaacttaaaaataccagttgccgaccactagataattcttcgcagaattggtagcctcgctgcgcaaactgctttagttgcgcaaccttttgaacttcattttctgccataaatcgcaccatttcaccgcgtgcaattttggctttggtagctttttgctttactttaccgtccactagttcgccaaaaacgcaggttatcatctgttggtctgcttgtaaatagggctctattacccgagcatattctttagacgctaagttgatcaccacttcggtctctttaaataattggtgatagatttgggcgcccaaaaatcgtataaattttgttgacctgcaatttgtaagcgggcctgcatttctaaccggtagggcacaattccatcaaacggacgcaaaatttcatagagtcctgagagaatccgcaaatgatcttgtaaatagttaagctgcggactagtcattaagtcggcacccaaactttgatattggataccagtatacgcaagcacggcgggcgtttggttgcgtaacaaatcaagtcggcgcgtattttcatagttgattacggctagccgatcactgcatttccaaagctgctgaagttcatttaagttcatttttttcaatcgattaacaatttgttgggcctgacttagaaaatgcggctggttaaggacggcaaaggaatccgtatccacctgcatttgcttagctggcgcaatgattattttcatgatatttattcaccactctttagttcattctaacaaattcgacgcgtttgtttcacgtggaactgtaaaacaaaaagagcgtgtgccaaaggtcgggtaacttgcgagcactaactaaaaattgaccaatatgcctgagactggcatattggtcaattttaggttaagcggaataaactgatttttgacgcacattttaaccctattaaagtcaaagtgcccaaatgttttttagtttttctcagcctattatttaattaaatcttcgcaatttttccttgctgaatataaacgctcaagattgcgatatccgcaggagttactccgctaatccgagaagcttgcgcaatcgtggttggccgaattttttctaacttttgccgtccttcagttgctaacccgctaatcgcgttatagtcgattcgatcaggaattatcttagcttccatcttcttcaaccggtcaactcgttcttgggctttcttgatgtagccggcgtacttaatttcaatttccacctgttcaactacccggcgatcgagctgcttttctgaagctggaatgaacttcagcaaatctgcgtaggtaacttccggacgccgcaagaattcggctgccagaacaccatcctttaagccatgggaacctttagactccaaaaattcctttacttgaccaggtttaatgcgaatttgttccaaacggtgaagttcatcttgaatatccgccttcttttgtaagaatgccgcatattcttcttcactaaccaaaccaaggtcgtgacccatttcagttaaccgtaaatcggcgttatcatgccgcaaaattaaccggtattctgcccgactagttaacaagcggtacggttccttagttcccttagtaaccaaatcgtcaatcattactccgatataggcatcgctacgttttagcgtaaagggttcctgtccgagtgctcgacggcctgcgttaattcccgcaattaaaccttgtccggctgcttcttcataaccggaagttccgttagtttgacccgcggtgtaaaggttcttaattaacttcgtttccaaagtgttcttcaattgataaggagccacaacgtcgtattcaatagcgtaaccagggcgcatcatttctgcgtcctctaaccccttgatggagtgcaaaatttgttgctgcacttcttctggcatcgacgttgaaagtccttgaacgtaccattcgtcggtcttccggccttcaggttcaaggaaaagttggtgacggtccttgtccgcgaagcgcacgattttatcttcaattgaaggacaataacgtggtcccacgccttcaattactccggaaaacatgggtgctcgactgagattttcccggataatttcgtgcgtcttctcgttagtgtaggttaaccaacacgacaattgattctttaattccaaatacttactatccggagtttggaaactaaaatggttgggttcctcatcaccaggttgttcttcggtttcggcataatggatcgttccgccatcaacccggggtggggtccccgtcttaaaccgttctaattcaaaatgatacttttcagttaaattcttcgtcaactctaaagctgcttgggagttgtttggtcccgaagagtattgtaattccccaatgataattttaccgcgtgcggcggttccaagggttagcacaacgctttttgcgtggtagcgcgccccggtattggtaattactcccttgcagaccccgtcttcgacaattaaatcatctacaatgccttgacgtaacgttaagttaggttccgcttcaatcgtctttttcatttcggcgtggtaggcatgcttatcagcttgggcacgcaatgcccgcactgctgggcctttcccggtatttaacatccgcatttgaacgtaagttttatcgatattgcgacccatttcaccgcctaaagcgtcaatttcccgcacgacaattccctttgcgggtcccccaatcgacgggttacatggcataaaggccaccatatcaaggttaatcgtcattaaaagggtcttgttgcccatccgggccgctgctaaagccgcttcggatcccgcatggccggcccctaccacgatcacgtcgtaatcgcggccgtcatattgttttacttccaacattcttcaactccaaatttattttcctaaacaaaattgactaaataattggtctagcaactcatcttgataactatcgccggtaatttcgccgagtaggtcccaagcccgggtcatatcaatttgaactaaatcaacgggcatgcctgcttcaatcccgtctagtacggaatctaaagcagtcacggtttgttgtaacaacccaatgtgccgggcgttagtaaccattacgttatttgaactattttcgatactgcccgcaaagaataacttcgcaattcggtcttccaaatccttggttcctaaaggcgctaccgccgaagacttaatgatttctgcttcactagcatatttctgaagttcatttaagttaattttagttggtaaatcagtcttatttaaaactacaatccgctgcatgtttgcagtttgatcaagtaactgccgatcttcatcgcgcagcggcacgctactatctaacaccaaaattactaggtctgcctgttgtaaggctttccggctacgatcgaccccgattttttcgaccttgtcttcagtttcatgaattccagctgtatcaactaacttaaggggaaccccttgaacattcacgtattcttcaattacgtcccgggtagttccggccacgtcggtaacgatcgccttatcttcatgcaagaggtggtttaatatacttgatttacctacgttaggatggccaatgattgccgttgctaaaccatcacgcaataccttaccttgcttagccgttgctaaaagctggttgaccttggctttaacttcaatcgccttttcttttaacaatcgcgtggtcatcgtttcaacatcgtcgtattcaggataatcaatattaacttcaacttgagctaaaacatctaaaatatcttgtcgcaaatttttaattaagtgggaaagatttccgtcaagttggtctaaagccaccttcatcgactggtcagttttagcgcgaattaaatccataaccgcttctgcttgggacaggtcaattcgtccgtttaagaaggcccgttcggtaaattcgcccggtttagccaatcgggcatctagcccgagaattaattgtaaaatacggtttgttgccacaattcctccgtgacaattaatttcgactacgtcctctttggtataggtgtgtggagcacgcattaccgaaaccataacttcgtcaatttcttcctcagtagcgggatccacaacgtgcccgtagttaatcgtatgactagctactttggcgaggtccttgccccggtaaatttgactagccacttttaacgcgttaactccgctaatccgaatgatcgaaatcccgccttccccaggaggcgtcgaaattgccgcaattgtatcaaattccgttgaaacacttggcatcgctaatatcgtcctttctatttccaataaaaaaagcgcaattccacctaaataaataatcgtcaccagacgacgtcagatggacaaagcactttcactacttcatcatattcaattcatacgcatatatcataaaagtttcgtttttgtttgtcaattactttattttacgattgctcataaaaaacgccaactcaccgacaccggtaaattgacgttcaactcagcttttgtaactacaattgaagttcacgaactatttccgtttactcttcattgccttacgtttagccttttcaattgcttttcgttttgctttttcggcttgtaacttggcttgccgttctttttgaatcttaaatggattttgaattaccaacgtttgacccacttggaagaggttcgtaaccacccagtacaaagtaatcgcagctgggaagtttagtgccgtaatcaaaataatcaatggcatcccaaaggtcattgccgaagtcattccattttgtgcgcccgctggttgggccttcattgaaagccaggtacttaagaaggtaaagattgccgccaaaattggcaagatatagtaaggatccttatcgttaagttgcaaccataggaaggttccttcttttaatacctgtgttcgacttaccgccgcgtacaaagcgtacattacgggcaactgaatgattaatggcaaacaccccgccattgggttaacgcctgcttcagcataaagtttttgttgttcttcacgaagcttctgttgggtttcaacatcgcgtgaagagtacttctgttgaagctcttttaacttgggttgaagttcagccgtcttcattgaagtcttcgtctggtaaatcatcagcggtaaaatgatgatccggattaagacggtgaacacgatgattccccaaccatagttatttccgcaaattttcgaaagataaatgataaatttcgaaaaattgtaaacaattacgccgtcccaaaaaccggtactgtgactggtaattggtgcggtgctacatgccgttaatatgaaagagagcgctaccacactcagcaaagccaaatttcgttttaaatgtttcactattcttcctcactttgtttcgaagcaaacagtccagctaatttaaaaacgtgttccaactggcgtttaacttctttcattggtaaacctgaagcttgtgggcgagcaattactaaaaaatcaacgtccgaacgcaaaaggggcttgaattccaagatactttgccgaattcggcgcttcatataattacgcattaccgcattaccgatttttttacctacggaaatccccacccgaaaatgtggttgcccaggtttatccattacgtaaacaacgaacttcttatttgcaaatgaatttcgggtttcaaaaacttcttgaaactctttttctttctttattcgatatgactttcgcataatccctcaccacaatctcattcactatcacatattatatgtaaaaaccgttagcttgtctctagaaaataaaaataaaagaccactgggatcagtggccttattatgcagataatacttttctacctttttgacgccgacgtgctaaaactttacggccgttgctcgtgctcatgcgtttgcggaagccgtgaacgcgttgacgatgacgtttctttggttgatatgttcgtttcattatggtccacctcctgaacgaaaatacacatactgaatttttatatcttaagttgattctcgataaatcagtttatgtcctttaaaacaattaccttaacataatagcacatttgccatagaaagcaaaccaccaaataaaacctaacggaaaaaattatccacaaacagagcgttagtttgtcgattaaattgtggataaccattttagtgattttcgattttgcacaggctttttcgcagcgattttcacaaatcacagcctgtttatagagttatccacagccttgtggaaatctgtggatatgtccaattaacgccgttattacaacatcttttatccacaggttggtgttcacaactctacttttggttttaaggatgcgccatttccccagcctgtggaaaacccaactcacagcctgttattttacaccatttagttttccacacccctgtggaaaaccgattttttttatgataaaatgaatgagctaaaaattttggaggaataaaaagtgcctaactatattgacctttggaaccatatcaaaaatagtttcgaaaatgacgactcaatgtcgaaagctagttttggtgcttgggtggacacggccgaaccaatttcattggataaccacgtaatgaaaattaaggttctatctaatttgcaccgtgactactggacgaaacatttaatggaaaaatttgtcgaatacgcctaccagttcacggatcaggacattacgcccgaattcgtgacggaagacgagtttaaagctcaacaggcgcaaaagccccagagcactgacaaatcttcgtccttctccaccgaagacacccagcttaatagtcgttacactttcgatacctttgttatcggaagtggtaaccagatggcgcacgctgctgcaatggcggtttccgacgaacccggcgttctttacaacccgctcttcttctacgggggcgtggggcttggaaagacccatttaatgcacgcgattggccatcagcttttagaaaacgaccctcagacgcgggtcaagtacgttacaagtgaagccttcacgaacgacttcattaattccattcagaaaaacaccacggaagaattccacgaaaagtatcgcaatgtggaccttttgttagtggacgacgtacagtttttcgcggataaggaagctactcaagaagagttcttccatacttttgaggcgttgtacaacgcgcaaaaacaaattgtgctaacgtccgaccggttgcctaatgaaatccctaagttgcaagagcggttggtttcccggtttaaatgggggttgtccgttgacattacgcctccggatctcgaaacccggatcgctattttgcgggaaaaggcgcaggctgacaacgtggaaattccagatgagactctggatttcatcgctaaccggattgattccaatattcgggaattggaaggggcgatggcgcgcattcaagcctacgctcaattgcaaaatgccgcgattactaccgatttggcagctgacgcgctgcggagcttgaactttggcagcaacctcagtcacgtcaccatccccatcattcaggataaggtggctaagtacttccacgtctcggttgctgatttaaaagggaagaagcgtttgaaatcaatcgttattccccggcaaatcgcgatgtacctttcgcgagagctgaccgataactcgttgcctaagattggaactgaatttggtggcaaggaccacaccaccgtcatccattcttgcgacaaaattaaagcggccttggaaactaacagtgatttagctcgtcaaattgacgatttaaagagcgagttaaaaccgtaaattgtggataagtgtggataactcaaaaagttttccacaagtactccacagtaagatttgggtttctcccgcttcgttttgagttatccacagtgctaacagcccttattactattactatttttttagtattaattaatatatacatgccacgtgtaaaaaggagttttaaaacatgaaatttaccatcgcacgaaatacgttcattaaaaaattaaacgcagttcaacgcgcaatttcttcaaaaaccacgattccaattttgaccggtttaaaaattaaagccgaagcagaccaactagtgttaacgggtagcaatacggatatttcgattgaaacaaccatttccgttaacgatccggatgcggaattagacatcgaacaaacgggtgacattgtgttaactgcccggttcttcagtgacatcgttaaaaaattaccagacaacaaaatgttagttgaggtttcggacgggttccaaaccacgattacttcgggagcatccgaatttaaaattaacggtttagatgccaacaacttcccacatttaccagaagtggacagtcaaaccacgattacattgcaagccgatgtatttagcgaaatgattaatgaaacggttattgcggtttccaaccaagaaagtcggccaattttgaccggaattcatttcacgattgaaaacaataagttaaccgcggtcgctacggatagtcaccgccttagccagcggatcatcaacttacccgaagccgtaaaaatgccggaagacattatcatccccggaaagagtttgttagaactttcgcggatgttggatgaagaaattgacacgattacgttgcaaatttcggaaaaccaagctttgtttacgtttgatgaaaccttgttctacacgcgtttactagagggattgtacccagatacttcccggttaattccaaaagaaagtacgacggcgatggaatttgaagcacccgaacttttagcttcaatcgaacgggcttcgttgctttctcatgctggacgcaataacgtggttaaattaaccatcaatgcggccgcaaagaaagcgattattacgggggattctcccgaagtcggaaatgttgaagaagtagtggttactaaagatatccaaggtgaggatttggaaatttcatttaatcctgattacttgaaagatgcactacgctcgttcgggcatacggcaattaaaatggaattcacttcaccattgcgtccatttacgttggtcccaacggaagatcaagaaaactttattcaattaattacgccagtacggactttttagggattaaaaaagtaacctaacgctctgtatggtaaaaaaattaaaaaacaggttcggcagctaaggctccggacctgttttttttttgtgggataaattctaattgggggatcaataattaaaagcaacgcggaggagttattattttatggtcgctttgttgaaacgaagcgcccagattaagctcgcgcgctttcctgcaatgaaggcgaaacgtgcgccccgccccagtttcttccgggtaaccaaggattagcctcaaccacctaacccgcggttaaggctaatcctcagttaatccttgtgcttcgctgcagcatggtcgaaacgtgcattgaaacccagtcttctgcggctaaccaagctaagggcttaatcacgaacttggtgattaagcccttaactcagttagtcctcaaagcctacccaggtttcaatgcactcttttataatcccctcattttaattttaagaaaaattacccttcttaaggcaaaaatgattcaaagggggtaaattcgctgaaaagccttttgagcgcctgattcgattgttttttgtctaaaataagggtataatatataagaagatatgtggggtgatgtcatgcaaaaagaaattgaaatcaacacaccgttcattacgctaggccaacttttaaaagaagagggcattatcggaaccggtggacaagcaaagtggtatttacgagaacacactgttttagttaacgaagaaccagacgatcggcggggacggaaactctacgctaatgatgtcatcgaagttcctgacgaaggttccttcaagattacgacgaaatctgggaagtaaatgtatttaaaaacacttgagttgcataattttcggaattatgcggaccttagcgtggaattcggttcggggatcaacgttttgctaggcgaaaacgcccaaggcaaaaccaatcttttagaatcgatttattttttagcgttaacgcgcagtcaccgaaccagcaacgatcgcgacttaattggctggaaagctaaggaagcccgggtattggggaccattcaaaaagaacatacgcaaaccccggtggaaatcgacatttcttctaaggggaaaaatgccaaagttaatcatattgagcaaggccggttatcacagtatgttggccaactcaatgtgattttgtttgctccagaggacctttcgattgtaaaaggctctccagcagttcgccgacggtttattgatatggaatttgggcagatgagttctaaatacctgtacaattctgcgcaataccgctcggtgctcaagcagcgtaaccagtatcttaagcagctgcaaatcgatcctaagggagaccaagtttatctggacgttttgagtgatcagctagcggcatatggcgccgaaatcatttttcaacgaattcagtttttaaaaaagctggaagagtggtcgcaagccgtacacgaagaaatctcgcaaggtttggaaaaattaacgtttcaatacgtgtctccgctcaaaaaggatgagactacgtcgaccgaaaccatttacgcggcgctccaggagctgttgaaaaagcatcgccaacgagagttacaacagggcaaaactttggtgggaccacatttagacgacgttaagtttatcgtcaacggaaaaaacgtctccacctttggctcccaaggacaacaacgcaccacgacgttaagcgtgaagcttgcggaaattgacttgatgaaagaagaaactggagagtatccggttctgttactcgacgacgtgctttcagaattagatgatagtcggcaaacgcacctgttgaccgcgattcaaaataaggtccaaacctttatcacgaccactagtttaagtggcgtggcgcaacaattaattaacgaaccccacgtctttaacattgaccacggagttttaacgcaaaacgaggaggaatagcttttggcagacgaaaaagagacgaaagcagaattagccaaagaatacgatgcgagtcaaattcaggtcttagagggcctggaagcagttcgtaaacgaccagggatgtacattggttcaaccagttcccaaggtcttcatcacttggtttgggaaattatcgataacgggattgatgaagccttagccggatttgcaaataaaatcgacgtggtcgtggaaaaagataacagcattaccgttagtgataacggacggggtattccagtagacattcaaaagaagaccggaaaacccgcgctggaaactgtttatactgttttacatgccggtggtaaatttggcggcggcggttacaaggtttccggaggactccacggggtgggggcttcggtagttaacgctttgtcgactgaattagacgcacgggttatgcgcgacggtaagatttactacattgactttgaacaaggaaaagtaaaaaccccaatgaaggttcttgggcctaccaagaatcctgacgatcacggaaccatcgtgcactttgttccggatccagacattttccaagaaactacggtctttgatatcaacatcctccggacccggattcgcgagttagctttcttgaacaagggcttgcggattaccctccgggatatgcggccagaaaagcctaccgaagacgacttcttgtacgaaggcggaattcggcattatgtagaatacttgaacaagggcaaagaagtgattttccctgaaccaatttacgtggaaggcatcactaagggaatcacggttgaagttgcgatgcaatacattgaaggttaccaaagcaagttgctgaccttcactaacaacattcacacctacgaaggcggaacccatgaagaagggttcaaacgggcattaactcgggtaattaacgattacgcgaaaaataccggaattttgaaagaaaacgacgacaaactttctggggatgacgttcgggaaggtttaacggcagtggtgagcgttaagcatccggatccccaattcgaagggcaaaccaagaccaagttaggcaattccgatgcccggaccgcggttaacgaagtgtttgcggaaacattcagcaagttcttgttggaaaatccaaaagttgcgcggcaaatcgtggacaagggtgtgttagctgctaaagcgcgggttgctgctaagcgtgcgcgggaagttacgcgtaagaagagcgggttggaattaaacaacctgcctggtaaattagctgacaatacctctaaggaccctgaaattagtgaattgttcatcgtcgaaggggactcggccggtggtagcgcgaaagccggtcgttcacgtctcacgcaagcaattttgccgattcgcgggaagattttgaacgttgaaaaagcaacgttggaccgggtgttggctaacgaagaaattcggtcgctatttaccgctttgggaactggctttggggaagattttgacgtaaccaaggctaactaccataagctaatcatcatgaccgatgccgatgtcgacggagcccacattcggaccttactcttaacgttgttctaccgctacatgcggccaatgatcgatgcaggctacgtttacatcgctcagccacctctgtaccaagttcggcaaggtaagatgatcaagtacatcgattccgacgaagagttagaagcagtgctcggtcagctttcaccatcgccaaaaccagttatccaacggtacaaggggcttggtgaaatggatgctgaacagctctgggaaacgaccatgaatccggaaaaccggcgcttattgcgggtttcagctgatgatttggacgctgctaacggggactttgaaatgctgatgggtgacaaagtagaaccccggcgcaaattcattgaagacaacgcggtcttcgttgaaaacttggatatttaaacttaaataatttaaaacagcccagaaaattaagggggaaaatgaattgccagaagatatgtcaggacgcattacggacgttgacttaagtaaccaaatgcgcacatcattcttggactatgccatgagtgttatcgttgcgcgggccttacctgacgtgcgtgatggtttgaaacccgttcatcgccggattttatacgggatgaacgagttgggggttacccccgaaaaaccatataagaaatcggccagaatcgttggggacgtaatgggaaagtaccatccccacggtgattcagcgatttacgaatccatggttcggatggcacaagactttagttaccgctacatgttggttgatgggcacggtaactttggttcggtcgacggcgacggtgccgcagcgatgcggtataccgaagctcggatgagtaagattactttggaaatgttgcgggatatcaacaagaataccgttgatttccaagaaaactacgatggtaccgaacgcgaaccgtccgttttaccgtcccgtttcccaaacctcttggttaacggagcgaccgggatcgcggtggggatgaccactaacattccgccgcacaacctttctgaggtaatcgctgcgattcatattttgatgaacaacgaagatgctacgacggccgaccttatggaagctttaccgggacctgatttcccaactggcggaattgtcatgggtaaatccggaattcgcaaagcttacgaaactggtcgcggaacgatcattttgcgcgcaaaagtggacattgaaactgaaaagaacggccgcgaacggattgtagccacggaattgccatacatggtgaacaaggcgaagttgattgaacgaatcgctgagttagctcgtgataagcggatcgaaggaattacggacgttaacgacgagtctgaccgggacggtttgcgagtggttatcgatgtccggcgcgacgtcagcgcttcagtagtgttgaacaatctttacaagatgaccttgatgcaaacgaccttcggattcaacatgttagccatcgttaacggtgcgccaaaggtattgagcctcaagcaaatcttgcaatactacttgcaacaccaagaagaagtggttcgtcggcggactgaattcgacttgaagaaggccgaagcgcgggcacacattttagaaggtttacgaattgcgttggatcacatcgacgaaatcatcgccattatccgcggatcccaaacagctgaagtggctaaagaccagttgatgaacaactactcgctttccagcaaacaagcgcaagccatcctggacatgcggttggtgcgcttgaccggattggaacgggaaaaggttgaagacgagtatcggaaagttatggcagccattgccgactaccgtgatatcttggctcataccgaacgaatccatgaaatcatctataacgaattgcttgaaattcaagaaaaattcggggatgaacggcgcacggaactgatggtcggtgaagtcctcagccttgaagacgaagacttgatcgaagaagaagacgtcatggttactttgacccataacggctacatcaagcggatgccaacttccgaatttaagacccaaaatcggggtggtcggggaattcaaggaatgggcgttcacgaagacgacttcatcgaacacctggtttctacctcgactcacgacgtgttactcttctttacgaatgccggaaaagtttaccggatgaagggttacgaaattcctgaatatagccgtaccgcaaagggaattccggtaattaacttgttgggaatcgatagtggtgaaagtatccaagcggtaatcaacattggccgcggtaacggagatgaagataacgaacaccgttacctcttcttcaccactttacaaggggtggcaaaacggacaccggttgcggaatttatgaacatccgcagcaacggacttaaagccattaacctcaaggacggcgacgaagtaattaacgtggtaattactgacggacaccaaaatatcattatcggtacccacaacggttacgcaattagctttaaggaaggcgaagtgcgttcaatggggcgctcagcaaccggggttcgcggaattcggttgcgggagaatgactacgtagttggttctgcggtgcttgctcctgaaagcaaggtactggtcattaccgaaaagggttatggtaagcaaacgcctgccgaagaatacccaattaaaggccgtggcggtaagggaattaagactgccaacatcaccgaaaagaacggtccgttggctggcttggtcaccgtggaaggtaacgaagacgttatgttaattaccgaccgcggagtgatgatccggtttaacgtggataacgtttcgacaaccggtcgttctacccttggagtacacgttattaagacggacgaaaattctaaggtagctacgatggcgattgttgaagaggaaaaggacgacgaatccgaagactctgccgacactagcgccgctactaatgaagctccagcagcttctgcagaaactcaatctgaagaataaaaaataaaagtctgattttcgaagtactttataagtgtatatcgttaatcaggctttttgttattgcgtctaactacgttgaatgttataatctttatttgtgagttgccagcgttttttggcagactctccttgctttctacagttgatagaaggccataagtccaagaggaggtgtatatcaaatggaaaaaaattacgaaatcacatacatcattgctccaaaccttgacgatgcagctaagacagctttagttgaacgtttcgacaagattttgactgacaatggtgctgaaatcgttgattcaaaagactggtcaaaacgtcgtttcgcatacgaaattggtggttttaacgaaggtatctaccacgtagttaacatcaaagctagcgatgacaaggcgttgaacgaattcgaccgtctttcaaagattgctgacggaattcttcgtcacatgatcgttgtacgttaataataatcgttaaaaatcaaggaaggagtggatattatgattaatcgtgccgtactagttggacgtttaacaagagatcctgaactacgatatacaagtagtggcgctgccgtagttagttttaccgtggcggttaaccgtcagtttactaactcacagggtgaacgcgaagcggatttcatcaactgtgtaatgtggcggaaagcggcggaaaacttcgccaacttcacgcgtaagggctctctagtaggtatcgacggtcggatccaaacccgttcgtacgaaaaccaacaaggacaacgagtatacgttaccgaagttgttgcggataacttctcacttcttgaatcccgttcggcttccgaacgccgtcaagaaaatgaaggcttcaacaacggtcaatctgccccttcacaatcatctgctggaaatccttttgacagtggtcaagcgaataacaatggtgctgcatcgcagcctaacaattcgaacccgaacgatccgtttgcaaatggcggacagtcaattgatatttctgacgatgatttaccgttctaaaatcaaattatagaggagggcaatcactaatggcatatcaaaaacgtggcggccgtcgtcgtcgtaaagtcgactacattgctgcaaaccacattgaatacatcgattacaaagatactgaattgttaaaacgattcatctcagaacgcggtaagattttacctcgtcgggttagtggaacaagtgctaagaaccaacgccgtttgacaatcgcaatcaagcgcgcacggatcatgggcttgctaccattcgttgctgaagactaagcttcggtaaagtaatcaaagtaagcgaacatagagactagaaaaacgaattagtttttctggtctctttttcttgtggctgagctaagcgcaaaccgctaaatataggggattttttgacgacgaactttccaatctaaacggctgttttatgtcaagccaagtatggtaaaatcaaagatagttagacacatttttttaggagaagtgttatgaaattagtcgatcgtctaccagcgtttatccgtaatccgcgagtaggaatcgttgctgtggtaattacggtgctttcgttgattggactgggattagcgttttatattaatccggttattggcgtgataatgttaggattggttatcgtgacgggggttttcagcgtacggacgttgaatttaattagtgacgaaaccagtaaatacattgcggagctatcttttcgggttgatcaagctgaagaagatgcaatgctatccatgccgatcggaattttaatctatagtgatcaaaagcgggtcgagtgggtcaatcccaagttgcaacattactttggtgaccaaaaggtacttgggcatttgctgaccgaagttgacgaagacttggcggaagtcattgaccggcatcaagaccaagaagggcttaaccgggtcgaatggaaggaccggacttttgacgtactggtgcaaaaagatgagcgggtggcgtactttgtggacgttaccaactacgcacaaatggaaaatcgttttgaaaatcgccaagtggtaattggacaaattttcatcgataattatgatgaaattacccaagccatgacggactcggatgtttccaacttgaataacttcgtcaccaaccagatttctagttgggcgcagtcgtttggaatttacctgcggcgcgtggatgacgaccacttttttgtaattatgtataacgaaaccttacaaaaggttgaagaagatagtttcaaactgttggatacgattcgagaagccacttcgaagcaaaattcaccggttaccttgagtatcgggattgcttacggggatgacaaccttaataaactggctgacgtgtcacaaagcaatctggaccttgctttagggcggggcggtgaccaagtagtggttaaggctgaagatgaacctgcgcgtttctacgggggaaagacgaacccgatggaaaaacgaacccgggtacgggcgcggatgattggacaagccatccaagaattaatgaatcaagccgaccaagtctttgttatgggacatactcgaactgaccttgattcgttaggttcggcgctgggaattcggcggattgcccagatgaacaaaaaggaagcttggattgttcttgatcaagaaggcgtccattccgatgtgaaacggttgattgataagttagacgaacacgaagacattcgggattcaattattgacgccgaccaagccttggaactggctaatagtcagagtttactggtgatggtcgaccattcgaaaccatcgatgactacttcaaaggaactattcgagaagttaagcgaccggacgattatcatcgaccaccaccgtcgcggtaccgaatttccggaaaatcccgtgctggtgtacatcgaaccttacgcatcttcaacgggtgagttgattacggaaatgttcgaatatcaatcacatgatggcgatccgatccagcctatcgaagctaccgcgattttagccggaatcgaagtggatacgaagtcgtttaccgaacggaccggaacccggacgtttgatgcggcaagttacctacgctcggtaggggccgatgaagacttgattcggtacttgctgaaggaaaacgtggaaagctatatgcaacgcaaccacctgatcgacacggtccaatttgtcgacgtgaagtacgcgatttgtgttggggaagaggatcgggaatacgatccagttattgcagcccaagcggctgattccctcttaaacatctcgggtgtggaggcttcgtttgtcattacccgacgatctgatgatgtcgtgggaatttcagcgcgcagtgccggtacggaaaacgtccaaattatcatggaagaactgggcggtggcggtcatttagcgatggcagcaacccaaatgaaggacgttacggtagccgacgcgaaggatcaactaattgcacttttgcaaaaagatgaagaagaggagtgattctgatgaaagttatttttatggaagacgtaaagggtaagggtaaacgcggagaggttaaaaacgtccccgacggatacgcgcaaaacttcttaatcaaaaatggtaaagcgaaggcggctactaaagcggctatgagcgaattaaaggggcaaaaaaaggctgaagaaaagcacgaagccgaagtgttagcagaagcccaaaagttaaaacaagttttggaagctgacgcaacggtcgtggaaatcaaggccaaggctggtaaggacggccggttattcggttcgatttctagcaaacaaattgccacggcattggaacaacagtttgatattaagattgataaacggaaaattgagttgaacgagccaattcggagcatgggttacaccaacgtgcccgttaagcttcaccaacaagttacggctaaaattcgggtacacgtttctgaaaaataggtcgccgaaaatagctttcaactctagattttgagcatgggagagtatcatggataacgggattttagaaaatcaaacgccccctcaaaatattgaggccgaaaaggcggttttgggagctgtttttttaaattcagatgcgttgattgacgcaatggaattcgtcacggcggacgacttctacaaacacgcccatcaagtcatttttaagacgatggtcgagttaaacgatgctgacgaagcaattgatgcgttaacggtcaataatgccttagaagagcaccaccagcttgaagatgcgggcggcattacgtacattgccgaactagcaggttccgtgcccacggccgctaacgtaggctactacgcgaaaattgtgcaagaaaaggcactgttgcgaaaattgattaaaacggcgacctcgattgccaccatgggctacacccaggaaaatgacgtttcggaaattcttgacgaagccgagcgcgaaatcatggacgtggctgaaaaccgcaaccagactgggtttaagcccattacggacgtgttgacttcttcaatggaggaaattgaccgcctgtaccaaaatgatgatgaaattacaggattgccgacgggctttaaggaattagataaaattacgacgggcttgcacgcggacgaattaattattttagctgcgcgtccggcggttggtaaaacggcctttgcgttaaatattgcgcaaaacgtgggaaccaaaacggataaagctgtcgcaatttttagtctagaaatgggtgcagaacaactggtcaaccggatgttgtgtgccgaaggaagtattgatgcaaatcatttgagaaccggtcagttaaatgaagaagagtggcagaatttagtggtggcaatgggttcgttagcaaagaccaacatttatatcgacgatactcccggcattaagatgtcggaaattcgggcgaaatgtcggcgcttggctaaagaacaaggaaacttagggttagtagtggttgattacctccagctaatagaaggttccggtgaaaaccggcaacaagaagtttccgcaatttcccgtcagctaaagaaacttgctaaggagttgggaattccagttattgctctttcccagctttctcggggagttgaacaacgccaggataaacggcccgtcatgtcggatattcgtgaatcgggatcgattgaacaagatgccgatattgttgccttcctatatcgggaggactactacgaacgagacgacgggactaatcagcaggatcaggaccaagacccccgcgacgaagaagaccaaaacgtgggtccggtggaagtcattattgaaaaaaaccggagtggtgcccgggggacggtcaacctgctgtttattaagtcatacaataaattttcttcattagcatacatgcccgaagccggagcgcactagggcgattaggaggagacttcttttcaaagactggtttcagaccatttcgcctgagtcagtcttttactttataaaaaaattgggagggaattatgcgcgaattaaagttaaagtggttattgttaggggttttgattgatagtattgcgatgagctcggtgtggcccctaacgacaatttatatgaatcaagagcttggccattccttggtggcagccggagtagttttgtttttgaattcagtagcgagtattttaggatcatttgttgccgggaaactgtacgacaaatacgatagctattatttaattctgggtgggatcgtgttcacctggatttcatttttcacgctaattttcttcaatggttggcccacatacccaattttcctcgtgttaatcgggtttggaaccggctggatcgttgctttgaataattccatgggaacctcaatcaagagcaaggacggacgctacgtctttaacatgctatacttcgtacaaaatttgggagtaatgctgggaacggcaatcgtgggaattctcttcaaacacagcgttgcgccgcttttcacgattgcgacggtcatgtttaccgtattcttcgtggtggccttcttcacttatcgaatcccaaaggaagaccaatcggtacaatcagtgcaacagactcaaggcattcaatccaaaatgcctaaggttaactttacgattattatgtcgtttttcgttagtttggtaattatgtggatcttttaccaacaatggaacagtaccgtttcaatttacatgttgaaactgcacattccgcttcgtttatacagtttcctttggacggttaacggattatttattttgattgtgcaaggcctcttaagttcacgaggcggccgtttgttaaaggacccgtatcaccaagtttatctcggaatcgcgttcttcatggcctcctttggaattttggccgtggcacaccagtactaccacttcgtaattgcgatgatcgttttgaccgtgggtgaagcaatcgccttcccatcgattccagcgattgttaatagcctttcgccatatgaccaaaagggtaagtaccaaggtttggcgagtgcctttccgtcagctggtcgggcaatgggaccgttagtcggtagtatgattattgagtcgacttcctttgtcttcttgtatagtctcgggttatttaccattttagtagtgctggtagtaatcgcgttgattatcgaaagtacgaagcggaaggcgaccttgtacgataataatcaggaataagacgagatttgggccggcagaaaccggttggtagcactcacttccacgatgcaggacggaagtgttagcaataattagttgcataataaaaatggtagttttcagtcaattaatgctgaaagctaccattttttgttataaggctacggaagtaataaataaattgaccagattaggtatatgactattaaaactgcgttaacccccacgggaaagtgggcaaagagatctttttgtatattacagtggatactgttattagtaaaaaacaaaaggtaaattatggttaagacggagttggcgtaatacaatatagttttattttgtttgataaatttcagcataatcgttttcctttataaaaagaccaatcccaaagacgttgcaactcatttcgatggagggttacttatccgatgttctttgaccgtcctagtctctacagcttgtcggcagcgatctcccagccgcatttgaaatacggcaattattctccccaagacaagtaaattgaccaggttagatatatcgctgctaaagatacgttagcccatacgggaaggtgggtgaatagatatttttgtacgttacaatggatgatatcgtttgcaaaaaacaggaagtaaatcaaacttaaaagaatgtcagcatagtagagcctggttttgttgcgtttgataagctttagcattgcatagtccctccatgaagaattctatccagaatagttaataccattgaataatacgcccgataaagtgaaattgcaataagcaaataaaaaaacgccccgcaacgggcgccttacttaaatcatattataaaaagaacattgtcagcaccattgtaattagcgcgggtgctccctggatccacagaatacgtttagctacggtgagggcgccgtaagcagcaatgatgaaaatgccggctagcaagccaattgccattccgcgaagcagggtccctccggggatgaagatgattaagaataaggacaaggcgacaaagccgttgtaaagtccctgattggcaagcgccgtccgtaaatgaggccgttcgacttcggcaagcggtaagttaaaactcttcgcaattagccggtcgctgcctaaaagttccagtcccatgatgccaacgtgttctaatccgattaaaataattagtacaatggtaaatgtatgcaaaatattcaactccttggaactatcttataacgaatggccgcaaacgccaaatatttatcgcaaatgaagttaaatttaagttgttgaaactaaaattgaagttaaatcctaattattaagctagaattgaagttcagtttaagaaatgaagtacaaaattacccgcctaattgcggtttcgggcatttggctctggtgcaaaacgcgattaccatataaaatggtaacttaataagaaggaaaacgaggaagctattttgatcattctgggagttttgctgattgcgtggttaggggcgttagttcggacggtgtttggctttggggaagccctagtatcaatgcccttattggcgttactgggatacgatttgaaaacgagtacggcgttgattggcgcggtaggattattggtggcgctgccggcaacgattcgggagtggcaccggattgatttccgggccgttcgccggttagtgaccggctctttaatcggggtacctctgggaattctccttgtaaaaacgttaccggcaagcgtggtgctacatggcttaggactatttttgattgtttatggtggctacagtttgtggcggagtcattcagggcgcgtagggaaaccgcatttggtagcaaaaggctacgattatttggcaggaatagtttcgggagcgctggggagcgcctataacagtcacggggtgccggtggcggtctatggaatgttgaagcaatggccggccgctcatctccgagcaattctccaagcacatttcctttgcgtgggtgttttagtggtgattagtcacgttgcggctggattttggtcgcttgaagcggtaaaagtgctcctaatggtaatccccgggctagttttaacggttcccttaggcaactggattgttgatcgaatggcaccggcccgagcgattaagtttgtttacggggccttaattattttcgggctattactcatgttgaaataatttttaccgttacaaatatttctaaataattggttaatatgttttattttttacggtatgttacaaaatgggctaattgcttgaaaaaatttaacgggcttgttaccataagcgtatattcaatggaagggatgttgatgggattgaagattacagactaattttcgaagattaagaaatgacgatttctttgtttttcggagtagtctgcggtttttgatccagtcagggtgcctatccaaaataagttatattggtattttgcacttttgtactgcgctaggaactgcacacctagtgctttttttgtgtcttaaaccgtcgacccccgaaaaaaatgggaggcgagctaattgggaattattcaaattaaaaatttaagttatagttatgatcaacaagtatccccgctgtttgagaaggtcaatttagaaattgacgcccggtggaaattgggcttaattggccgaaacggccggggaaaaacgaccttattaaaaattctacggggacaggtgccttatcaagggtaggtaaacactgatttgcagttcaattattttccagcaaaggtccccaatcctcaagcgcctttggaaaaggtgttgatggaaatcacgcaacgggattactctaatttttgggaagtcgaacgggaaatggaccgaatcggcttgcccaacgagcttcttgcgcgaccgtatgacgaactgagccccggacaacgtaccaaagcgcaattagcggcgatgttcgcgaatgcgggggctttccaactaattgatgagccgacaaaccacttggacgatgaaggccggcaacggttggcggattatttaaagcgaaaacagggttttatcgtggttagccacgaccgcgattttttaaatcaggtaatcgaccacgtcatcgcaattgaccgggctcaaattacgagcatgcatggcaattacacgacttgggcaaccgaacgccaacgcgaagacgagcgggagcggcgaaccaaagaaaccttgcagaaggaagttaagcaattatccaaggccgcccaccagaaacaaaattggtcaatggcgaccgaacgggaaaaggtgggcgcgcccgataagggttttgtcgggcataaagctgctaaaatcatgaagcgggcaaccacgattcaagcccgcgcggaagcaaaagtagcggataaacaacggttattgaaaaatatcgagatcgaagctgaacttcaattgaactacaatcctccccgacttccggtaaaggtgagccttttaacggttgaccaactggtggtaagtcgcggaaagggaccgttaaaccaaccgatcagtttcaacctcaaggctggcgaacggatcgtgctccagggacccaacggtgtgggaaaatcgaccttaattgcggcaatttcaggaagtccggagcttcgaacgaccggatccgttaatttacgaaatgggctgaaggtttcctaccttccccaggcgtttgacgcactaagcggggatttagcaagcttcgcgcaagcaaagggcgtagagttgcaggacttgttagccaccttgcgaaaattagggtttgaacgagaaatgttcacccaacgaattgaacagatgagcatggggcaaaaacggaaagtggctttggcccgtgcgctttgtgaacccgcccacctctatatttgggacgaacccttgaattacttagacgtaattacccgggaacaaatccaacagttaattctacgagtacggccgcctatgctgcttattgatcacgatcgggaatttgttcggcaggtaaatactaaacttttggaagttaaaacgagagtttaaaattgacaccgtgtcagaatgtggtattctaaccatattgacacggtgtcatttttgattaaggaggtggcaaagttgccctcagagacgctggtgaagttaaagccaactaaaaaagcggcgattgaaacggcccttttgacggaattttcgcgttacccagttgccgaggcgcaggtcgctcggattgttaaggatgcgggcatttcacggggagctttttacaattattttgctgatttaattgacgcttaccgttacatttaccaagtagccatgcacgacattcaccaatctttgcacgtcccggccgcccgaggtcccgctttagtgaccacggtccgtgattttgtggagaatgcgcattccagtaaatactacgagttattgcaaatgcactttcgccacaacgaagcgtacgtggcccattggattgccccggtccaccccggcggtgaacggcaatgggcccaacaaaccttggtacacgacacgctgcgcggagcgattgtggaaccggagactgcggaagctcgtttagcacaactaactaagatcctaaaaattctggaggaatagatatgtttttagctttgaaggagattaaacgcgaaaagttgcggtattcgctaattatcggcatgattgtcttgattagctacctaatctttattttgactagtttagccctggggttagcccaccaaaataccgacgccatcaactcttggaaaattaattcggtagttttgaatcaggatgcaaacgttaaccttagccaatccttaattacggatcagcaggtcaaggaccaaaaactaaccaaaaatgacgccctgatcggccaaatttcggtagtggccaaggaaggcaagcacgaaaaaatttcgtcttccttcgtgggaattcaaaatgaccaatttattgccaaacaattgaaattaaccagtggccacaaaattaaacacgaccatgaagtggtggtcgacgataagtttgagcaaagcggttataaaatcggcgacaagttgaagttaaacgacgcggaccaaacctttaaaattgtcgggttcactcataacgcgaagttaaacattgcgccggtaatttatggaacgttggatgactggcgggatttgaaacgggcaatgccccaaaccaaggccagtgcaattgtttcaaagacaaacgatttaaaggtgaaaaagcccctgaagacttacactaaaaaagcctttatccaaaaactgccgggatattccgcacaaaacatgacctttgctttgatgatcggcttcctgatggcaatttcattaattgtgatcgcaatcttcttgtacattttgacgatccagaagctacctaactatgcggtacttcgcgcccaaggaattccgagtcgggtaattgcgtggagcacaatcgcgcaatcattagtactggtagttagcggaattattatcggtacgttgttgacgattgccacggcggccgtattaccaccagcggttccaatggcctttgacgtgccaatgttatccgcagtgggcgttggattagtaattacggcgctcttaggtgcgttagttccgattcgtagcgtcatcaaactagacccggtaagtgtgattggaggataaaaccatggcagcaattgaaatgaacggcattaaccagatttacgggaaggggattgccgaagtgcacgtgcttcacgacattgatttcaaggcggaagcgggaaccctaagcttaattattgggccaagtggttccggaaagagtactttcttgacgattgccggcggtttgcggaccccgacgagcggtaaggtcaaggtcaacggtcatgactaccaggatagttcccggaaggcgttggaaaaattacggctcaatgaaattgggtttgtgttgcaaaactatcatttgttacccttcctgaccgtcaaggaccaattcaagttagttgataaggtcaaaaaggaccataatttatcgcaagcagaattaaacgacttgctcacccaactgggggtcgaagatttggtagataaatatcctaccgaactctcgggcggacaacaacaacgggtggcaattgcccgggccttgtatccggacccgtcgattatcctagcggacgaaccaacggcagctttagatagttcgcgggtaaaggaagtcggcaagatgtttgcccgactagcgcacgaacataataaggcggtcgtgattgttacccacgacatgcgcttaaaggactacgcggatcaaatgtttaagattaacgacggagttttgagtgcggaaaccctctaatggatttgttggtacgcagaaaaactcgttaattcccaaaaggagagtgggacaaaagtcggttagtttgcgagcattaactgaaaattgcccatcatgccaaaatcaggcatgatgggcaatttttggttaagcggaacaaactgacttttggcacacgttttggctctattgaagtcgaaaaaccaaaataacttttttatccttgaaaagtattttttagtttttcctagctttttttgctgaacttcactttaacttcaatgaagtttaacgtaaaatgaattgaagttaaataaaccgcggtatcggggcgtgcaacagggttgttgcttggcaaaactgtgggatatggcagaatgaagccagaaggagttgatcaaatgtcaatcggaccggcattacaaaaggtacgacaaaatcgtcacttaacccaagcggaggtggcgagtcagctgtacgtgacgcggcaaaccatttcacgctgggagcaggggaagacgacccctaacatctatgcgttaaaggacttagcggaactttatggcgtgtcgattgacgaattgaccaatacatcccttcttaatccagttcaggaagaaggagatccaatgaagcaggttaattggatggcattatttggtattttttggtttaacgttttgtttacggcgggagcggttgtcgcggtgatcggcattttagtagggttatgggttactatggtagcttttattggggcaccgctgttactatttgtggaatggctagcggtaatggcgtaccaccttccgtggccggaaagtttgacgtggtatgaagttccgttatcgttaattttttgcggaatcggcatttcaatgtggccgatggcaaagaacacgacggtttatttagccaacttttttaaaaaatacgtgcggtacaatctcaaagcaatttatcgctaggcaacttagatcggcaatggtgcatttcaggagtgcaatttgatggactttgaaatgtagttaagccggtctttttgtttgccacgataaccccaccagcaggttccaacctatcacaataggtatataccagtctaaaaaatagcttttttaacgcacatttgcggtaaaactaatcaaaaatatctaattatttatttgtaagggtttacatttatcaaaaatatttctatacttagtctgttggttgagttggatttttgggtaggttaccgtagttaggaggaaccgtagatgaataattttatgaactgggtgcagtccagtttgatgccaccgctggcgaaggcgggaaataataagtacttagtttcaatccggaacggtctggtattgaccttaccggccgtaattagcggatcgattttcttgattatcgcgaacatcccgattcccgcatggacgaactttatgaagccgtacatgggggcgatgggggtcgcggttaacggctcgtttgggattatttccctgttagccacgattggaattggttacgagttggcaaaggcgctcgatttagatgcaatcaacggtgcgggtttgtcgaccatggcgttcatcgtcacttcgtttaatagcaaactgacgctggatactgataattttgcttcttctggtttgtttactgcaattgtttgttcatttatttcagtttcaattttacgtttattcgtgaagaaggattggattatcaagttgcctaagggcgttcccgcggcggttagtcagtcgtttgcttccttaactcccgcatttttgattttgctatttttctggggattgcgggttccacttcattttgatattaatcactttattcaaagtattttccacccgttgctgtttgcgatgaacagtttgccgggaatcatgttctacacccttttggttagcattttatgggttgccggaattcacggggacatgacgcttcaaggaatttcggaccctattttcttacaatttttggcggctaacggggttgcgtacgcgcaccaccaaaccatcccatacataacctctctcggattttcgagtttgttcgttaacgtggggggaaccggggcaaccatcatgttggtcttctggatgctgtcttccaagagtaaggcctaccgggagttagggaaggtagccttcccaagtgccttatttgaaattaacgagccggtaatctttggttttccggtggttatgaacccgattaccttaattccgtttatcgtggttccgcaagtgttgacgattacgacgtacttgttaatggccgtgcacctaattcggccagccgtaatgatggtgccgtggacgatgccaccgattatcggtccattgatggccaccggttgggattggcgtgctggagtatggtcggcaattgaactagtgattgcgggtgtactctattacccattcttcaaagttgctgaaaaacaaatggtgcaacaagaacttaaagagggataataatggttaagatgttaattaaatatggtgcagcgggcgcgttcctaattatggcgagcgcaatcattttaacaaagctgcccttaaatagtttgaccgtcgaccgggccatgttggcgattagtttgctgatttttctggggctcggcgttgcgctgaaaaaacacgcttaagctaaagtagagggattgaaaatggataaattggaacggttaacgaaaacagatttgaatgatttctatcagctatacttgtacgcatttaccaatccggatagcgcggaacggcgggcgtttttcgaccatcgttaccagcattcggaaaagtacgggattaagtacgatggtcgattgggaagcggaatgttaagcatccccttccaggtcaactttcatggcgtgaagtataagatgaacgggatcggcgacgtcatgagttatcctgaatatggcggccacggagcgattactaagttaatgcaccaggcctttcaagatatgctcgcggataaggttgcgttgtcttatctggcaccattctcgtataaattttaccgtcggtttggttacgaagaggtgtttgaccagacgatctatcgggtgaaaaataccgatttgccgcgtattcgtgtggattcgcaagcaggttcgatggaacgcttgtcgctcaaggatgcgattccgtacattaaagaactctacaataataacccggatagccacaatgctggattggtgcgggcggactggtggtgggactacctcgtccttaagcatccgcattggcaagtgggcgtctactttgacgaccttcattccgcggctgggtacgtgatttacgaagggatcgacaccaccttttacattcaagaaatcatgtacaccaattgggaaagctaccaatacttggcgcggttcatttgccagcacgaatcaatgtacttcaactttgagtacgtaagtggcgatccggtcggtcgtccggatattttgcaagaacccgatacgctcaacgtggaaattaaaccgtacatgatggcccgaattattaatttggcgaccttcgtccaagattatccatttttaggtaaggtcaaaagtatccggctggcggttaccgaccaaatgattccggaaaataacgggatttggcggctgatggttaacagtaacgggacgagttttgaaaagattagtgacaacgaaaccaacatggcggacattcgcctttcaattcaagaattgaccaaggcgtttctcggttaccgttctttgggacatttaaaccgggtcggcgcgattcgcggatcgtacgcggccattacaggtttagacaacgttttgcgcaaagaatcaccgatgctgtgggactacttttaaactgaaaagccccgcgtgagttctcagaattaacaaaattagatggttaatcgtgaacgaaacgattgaataggggaaccggcaccgaatttaaaaataagccgttaatttaagcagacttctcaagaattttagtttcttggggagtcttttttgttagaaacgtgaccaggctacggatgaatttttacacgaaaagcccgggagcgatcaggaggaagacggtgcttgcggtaaactaagcggccgttaaaaaagctttagaaaataatgcacattgcttaccttttagaagcaaatacgcttatactatacgtgaactaagttgttacattttttggttaaaaggaggatttattatcatggctttgaaaattgggattatggttggtagtttatgaaagggctcctttaaccgactggtagcccaaacctttgaaaagttacttccgcgcgaagtagaaccagtttggattgaagttggcgatttaccgttgtataacgaggatttggataccgacaatccgccgatggcctggcaaaatttacggcaggcggtgcaaagtgttgacggagtgatgttctttactcccgaatacaaccgttcggttcccgcggcgctgaagaacgcgattgacgtaggatcccggcccatgggacaaaacgtttgggatggcaaaccagccctcgtggtaaccgtgtcacctggtggaattggcggatttggcgcaaaccaccacttgcggcaatcgttgaccttcgttaacatgccggtattgcaacaaccggaagcctacatcggcaacattacgcaacacatggacggcgaccaaattgatgaagcaacccaaaagttcttcaaacaaattgtgggtgcgtacctaacctttttacaaaggtttactaattaatcggtaaccaacgctttaaatcgagtataaaatcgcaatgcttttcgagaattttgcattctggagaagcatttttattttgtgcgtttttatgaatgatgaagtttcgcgagtggctcaagcgagacggaagttaaacgaattaaatgagtggggtacatattgaaatgggtgtactatttcgcaaaaataaaacatcgcgtaacgatgtttagaaagtttctactattatatagggatttaaatggaaagttttccgtggctttcttgtagtaagccatcaaagaaatgttggagcgagatttggccgttaggaacgtcttcgtggcgcatcttctgaatttcaatgtagacgttttggtattcaaaaagggcgttagcgtattctagtaaaatttcgttttcggagtactcgttgcacatgccggctaagttggtaatccccactcgtagtgctcgtcgaatccgttggtaaacgattttcttttcgtgttcgtcaagacccaggtcgcgctgaaagtcgatgctcgaaaaggaaatgttttggtcgaccatgatccgaatgattttcaagatttccttgttgccggtttcggaggcgatccctaagaagcgcagaatcgcgttaacccggtccatttgcaaacggtgctcggattggggccggttaaaaggcgttaccacttgcgacgaaatgttgtaaatctcggaaagtttactaatctgttggcaataggaggccactaaccgagtcacgtgtttaaattcgacgggactgaccggatgttctaggaagaagtcaattccagcgtggtaggcggcttccttagtggcgacatcctcggcggaactaatcataatgtagtgcggtttgatttgaacttgttcaagccgtttgattagttgaattccgacttccgggtcgttactactaataatcatgatgtcgacgcgtaattgcaacaagtcgtcgtaagcttgggtaggggaaactccgatccccacgaggttattgttgaaatcagcttcgataagatcccgaatcgtagtggtgtgacgggaatcgttttcaaataaataaaagttcatggctaaatggcctcctagtattgaaaaatcgtgatgtttcgtgaagcaatacgaaactaaacgttttatacaatgtttatacattaagactatataataatggattttttttcaaaccaaacgatcattttatccaaattatacactttgcaaccgaaatttatacacggaaaatgtgccctatgtcaagtaagtacgcgaattaaaacgatttcatggaatttaaggttaaattctaaagtgtcgtgaaaccgcttactatcattataagtgtaataaagatatttagtcaccttaaggaggatgttttcaatggcatttaatttacgtaatcggagtttcttaactcttgcagatttcaatactcgcgaaatggaatacatgcttaatttagcagaagatcttaaaaaggcaaagtacgcaggtactgaaggtaagcggcttgctggcaagaacattgctttaatctttgaaaagagttcaactcgtacacgttgtgctttcgaagttggagcaaaggatgaaggagctcacgtaacataccttggcccttctggatcacacattggttacaaggaatcagttaaagatactgctcgcgtattaggtggtatgtttgatggaatcgaataccgtggattctcacaacgttcagcagaaactttagcagaatactcaggtgttccagtttggaatggtttgactgatgaagaccacccaactcaagtacttgcagacttcttaactgccaaagaagtacttaagaaggaatacaaggacattaaatttgcctttgttggtgacggacaagataacgtatcaaacgctttgatgcttggtgctgctgttatgggtatggaataccacgtagtaacccctaaagaacttgaacctactaaggaagttctcgaccaagcaaacgaaattgctgctaagactggtgctaagatcgtggttacaaacgacatcaagagtggtgttaaaggcatggacgtaatctacactgacgtttgggtatccatgggtgaaccagacgaaatgtggcaaaaacgcatcgacttgttgaaaccataccaagttaacaaagcggttatggacgcaactgaaaatccaaacgcaatcttcgaacactgcttgcctgcattccacaatacagacactgaagttggtaagaagattcaagaaaaattcggtctttctgaaatggaagttactgacgaagtctttgaaagcgaccactcggtagtattccaagaagctgaaaaccgcatgcacaccatcaaagcaattatggttgctacattaggtgactaggaggttatcgtaatgacaaaaatggtagttgccctcggtggcaatgcgctcgggaaaagtcctgaagagcaattgaagctggtaaagaacaccgcttcatcattaattgggctgatgaatggcgataaccaagttgtcattagtcacggaaatggtccacaagttggtcagattaacctaggaatgaactacgcagccgaacacggcaaaaccgcagccttcccattccctgaatgcggggcaatgagtcagggttacattggttaccacttacaacaaagtttgcaaaatgaaattcaccatcgggggatgcaaaaaaacgtggtaactgcaatcacccaaattgccgtagacaaagacgacccggcttttgaaaagccaactaagccggtcggcgatttctacagcaaggaacaagctgacaaaattgctagcgaaaagggttatacttttgtggaagatgctgggcgcggctaccgtcaagtagttgcttcaccacttccaaagaagattatcgaattaaatagcatcaaaacgttgatcgaaagcggcgacctagtgatcgctggtggcggtggcggggttcccgttatcgaaactgacgaaggcttaaaaggggttccggccgtaattgacaaggaccgttcaagcgcccttttggctgacaacattgatgctgaccaattaatcatcttgacggcggtagactacgtttacgtaaactacaaccaaccggatgaaaaggccttaacatcgttgagcgtggctgaagctcaacaatatatggatgacaaccaatttgccgctggaagcatgttgccaaagattcaagcatgcttgtcctttgtaaagggccatccagaacgcaaagccatcattacttcgctaagcggattgaacgatgctttagcaggcaaactcggcacggttattcacgaataaaagcacgtttaacttgttaaatacagattttacagataaggagtgaatcaacatgacacaagcaattcatgtaacctcagaaattggtaaactcaaaacggttatgttgcatcgtccgggacgtgaaattgaaaacatcacgccggactatatggaacggctgttatttgatgacattccatatttaccaattgctcaagaagaacatgatttctttgcaaagactttgcgcgaccaaggaattgaagtactttacttctctaaattggctgccgaagctttagctgatgaaggtgttcgtcacgaatttctcgaacgcatgattgcagaatccggctatgtagctggtgcaactcacgacggattgatggaatacttgtcagcaatggatcctcaaaccatggtggaccgcattattgaaggtgttcgggcatccgacatcaacattgcgcaaccagatttgcaatcggtttcagaaaatacggattggccattcttgatggatccaatgccaaatgcttactttactcgtgacccacaagcatcgattggcgaaggaatttccattaacaagatgaccttcactgctcggaaacgtgaatcattgattactgaatacatcatcaagtaccatccacgcttcgctggcaaggttgaagtatggcgtgatcggaaccatgaaactcacattgaaggtggggacgaattggtacttagtgatcacgtattagcaattggagtttcccaacggacgacggcggacgccattgaagacatcactcgtcaactctttaaggactctaactacgataccgtgattgcaattggtattccacacaatcacgcaatgatgcacttggataccgtattcaccatgatcaaccatgaccaatttacagtacatccagcaatccttgatggtgacggccatgttgacaactgggtattgcatccagatcaaaacggcggcattacgatggaacatcataccgacattaaagaagttttgaagaaagctttgaataagtctgaaattgatttaattccaactggaaatggtgatccaatcgttgctcctcgtgaacaatggaacgatggttctaacacattggcaattgctccaggtgaggttgtaacttacgaccggaattatgtatcaaatgatttgctacgcaaacatggcatcttagttcatgaagttcgttcaagtgaattatcacgcggtcgtggcggcccacggtgcatgtcctgcccaattgttcgtgaagatgtaaagtaaaatttagacgctaaatggcagaagtgaactgtggtatgaatagcaaagcagtttgcttttgcctttttgattactaaatccaggaatggagtgaataatatggagaataaaaacggaattggccgcctgggcctgaccgcgctgatcgttagttcatgtattgggaccgggatcttcgggattaccaatacggttgcggcagcggcggcacccggacccgccttactatcgtgggtttttgtcggtatcggctttttgctactggtattgtcgttaaataatttatctgaaaagcgtccggacctcgaagccggaatcttcagttacgcgggtgctggatttggtccgctaggagaattcatctccggctgggcctactggttatcggcttggctcggaaacgtggccttcgcgaccatgttaatgagtgcgatcggaacgttcattccgacctttaaaggcggacaaaatatgccgtcgatcattttagcaattatcttttgttgggcactgaccctcctagttaaccgcggagtggaaagtgcgtcgttcgtgaacaccatcgggaccttcttcaaggtcatcccgttgttcttgttcatcattattacgattatcttctttaaaggacacatgtttaccaccgacttctggggaaacgtagccaacaacttctccaagggtacggtaactggttcagttttcgaccagcttaaaggaactctctcaaccttgatttgggtatttattggggttgaaggtgcgtccgttatgggccaccgggctaaaacccgtagtcaagcgcaacaagcaaccatcattggatttatcatgttgctagcaatttacgtaatgatttcaatcatcccttacggaaccttgacccgggcccaactagcttcagctagccaaccggcgttaggaaacgaccttgaattaatcgttggtcattggggagcgatgatcatcaacattggtttgatcatttcgaccgtgatttcgtggttatcctggaccatgttgccagcagaaaccaccatgttgatcgctaaagataaggtaatgccttcactttggggccggttgaacgagaaaaacgcgccaaccgcttccctttacattaccgcgatcttacaaacgatcttcttgttctccttactgtttacttcggaagcttacaactttgcttactcgttagcttcggctgcaatcctcttctcgtacctttttgtaggtttgtaccaaatgaagtacagtcacaaacaccaagaatggggacaattcacgattggtttgctttccgcactcttcatgcttgcctgcatgttcctgtccggatggcaacaaatgctattagtctcaattagtttcatccccggcttcatcatttactaccaagccgttcgcgaagatcatcgcgaccttggcggcaaagaaaaagcggtgatgggattaatcctccttttgagtgtagtagctatttatctcgtggctaacggaaccatcgtagttgcgtaaaaaacaacatactaagaactaaaaaataatttattttacagttaattcaacgaatgcagggcgtaaatgtcgctgcattcgtttttttttacgtgattattaatatatgcattgaaaacgtatttatgaagaggtagtattaaaatgtagcttaaacactgtaacgcaaatggaggattttcaatgaataagaaaagagttgcgggtgctgctttagcaagtgccttattatttgctccactgacactgcaatcagccaccgcgctagccgatagcttttacactagccaaaccaacgcggaacgggccgacattactaattgggtagccaacacttcccaagagattagtaacaacctcagttcgcaacatatcgacgtgaataatttacacggcgaccaatacgtgatccaatggggggacactctttcaggaatttccaacgcaacgggaatttcagtagctaagttggcttacgacaaccggatccaaaacatcgacctgatttatgcgggcgacgttttggtattgaaccgggatggcgaagtacctagcgactggagttatgaaggtgacggaaactacgttgccaagaccaaggtaaccatcaataactttaccgataatagcgaccactcggtaaatatcgacgtttcgccagtttccaataaacacattgataatagcgataacagcgtgaagaacgaatacgaatcgccaaaggatccgcaaccagatgctgatgacaaatcatcatccgcttcttcggataatgctgctaaagaatctagtgaagacgcggaccaattggacgaaaccgacttttcggatgctatccaagacgaaattaaggataaattgaacttggatgacgaccagttgaccgttgatttcacgggtaaggatgccgacgatgaaagtgacgacacggattctgccgacgaagacgtagattctgataccgatacggattctgataccgataccgacaccctttacgacgatgaccaaagcgtctccaccggtagcgatcaattaaccgaaaagaacgctaaaaagttggccgacaagattgttaaacaattaaaggaagacgacaaggataaggacgttaccgacgccgacgaaatcgaattgacgatcacggctgacgatgacgacttcacctttaacttaagtttgacgtccgatgatgattcggatagcgatgacactgccgatagcgacgaagacagtagcgatgcggacagtgaatcatccgatgatgaagatactgctagttccgaagacgaagatagcaacgacgacgaagatgcggataccgatagtgatgaagacagcgattcgcaagacaacgaaagcgacgatgaagacagtgaccaagcagtcgacaccaacgcggacgttgaagacgatgacgttgaataattaacgagagggattgttgattaaatgaagaagaaaaagtggaccattgtgggcgtgatcattgccgtgctggtaattatcggtggaggagtctactggaacatgagccatgctgtagctaagaaagttcctggaaacacttatatttaccagggcttatcaaaggataagtcagtgtacttaacttttgcggaaagcggcgatcacgtggtggtgagttcgaacaaggccgatgctgccaaagctagtcaaagcgcaagtagttttgaccgacagtataaagcccaagaaaagagtgctacttggagctataaggcggaaggcggtaccttaaccctggcggaagaaaccaaggacggccaagtttcccaatggcaatataaccacattctggcaacgaataagaagttcaccgcccggagctttacttaccaaatcgccaaggcgggccaggggcaggttaaacgtaaggtagttttcgaaaaagtttcgtaacgccgagcgaagataacgaaaaacataagttaaaataaataaacacttataatggaagcttttagccaaaagcttccatttttttatggtttaaaccagaaaacaaagccgactttcaatactttaagaaaattgtatgaacgataaaccgctttccgttaacggaattcataaaaagattcaaaaaagctcccatctttttcattttcaaaacacatttccccgataaactacagcaatgttgatatcgatattaaaggagatgggatgtaatgaaaaaaattcggggatggctcatttttgccgcagctttaatggttgcgctggtagcggtcgcggggtgggaatataccgcgcactctaaaagcgacctactatccgaagagcaaattattaaaaatctgggaacgaagttagttaccgaaaatagcaccaccgccttaaccaaaaagtacgctaaaattgttaaagatggcgactacgatttaaaaaatccatacataaaggtgaacccctataagacttcaccactaacggcgttggtatactttaaaacgccgaaaaaagcacaggttagttacacgattgaaggaaaatcagataagacctcgatcactaattcggtgaaggggtaccaaactaagcaccagttaccaattgtcggcttatacgcggactacgaaaataccgtaaaaatcaccgtgaagtaccaatctggtaagaaagaaactaaaacaattaaaattaagaccggcaagttaccgaagtaccttgaccaaaatgacgtcaaggtgacgaaaaacgataagtcgaagatgcaaattggcgataacgaactgactctggtcgaccggaccgctaagcaagtttacgcaatggacgccgatggccagattcgctggtactccactaactggaaccagcacatgttcgaacagctcaagaacggccacatcatggtattaaataagagttccgaaaatggaaaatacaacctcctcacggaaaccgactatctagggcgcatttaccggcaatattcctttgatggcaccctcggcggcaaccttagtcacgaggtaaccgtaatccaccacgacattgccgaattgccaaacgggaatttattgctgacggtttcggatggaagtaagtacaccgaggatacggtcgtggaactgaaccgcaagaccggtaaaattgtgcgggtgctcgactttaagcaaatcttgccggcttcaatgtaccaagatagcaagcaaaaggctagcgacggcaacattgggaccgactggctgcacatcaacgcactggactataattccaagacgggcaaactgctggtttcggcgcggaaccaagacttagtcatgcaattggattacgtgactggtaaaatcgagtggattttctcaggaaaggacaagaatagctggccggcaaaataccgtgacaaggtgctgagtccgactggcaataccaaggttaccggcggacagcacggcgtctaccttcttgaccaaaagggggaccaggaaaccatcatgttgtatgacaataacattgccgtacaaaatggcgatcagaagacgtccgggaagtattccgcaacgacggtttaccaaattgaccagcaaaagaagaccgtcacccagcaatggtcgtacggaaaatcactggggcaggcaaactttacgccgatcatcggttatgcgcaacgattagctaacggaaataccttgattaattttggctacaaaaacgacggaaaagaatcgaacgtgatcgaagttgatgccgatgggaaccaagtcttcaacgcaaccttgagcaacaatccggccgataagacctacgcgtaccgggcttaccgaattcagttctacccggaaaattatcattttgacgtaaccaaataatttaccaaaagggcttgaaattgacgctacggcaacccatataatgattttgaggaggtgaggggatgtattccatccaagatttggcgaagctggcggggattagttcgcgaacgttgcgctattacgatcagattgggctactagtaccggcgcggcgtacggagtcgggcacccggtggtacgcgaaagcccaggtagacgagttgcaacggattctgttctttaagacgttgggcgtttcgttggcaaccattcgggaaatcatggcgcaaccattggcgacgtaaattgcggctttggaaagccaacgcgggcgcatcgcggaaaagcaacaccggcttcaagatttagacttggcaatcgcctcttccatcaaaatgttaaggggagtgggcaagatgagtgacagtgaaaagtttagcagtttaaaggcccaaagactggcggaaaacgaaagtcaatttggtcaagaaattcggcaaaaatatggcgaggaaacggtggaagtcgccaaccaacactacttggcgctttcggaatcccaattacaaaaggcagatgcccttgaaaaagagttgggcaccttgttgcgggaggcgttgacgcaaaatagcgacgcgaccaaggcggcgatttttaccgcccatcaggagtggctgaaaatcatggttggtaagcagtattcgccagcttaccaccaaaatttagcgcaaatgtaccaagccgatgaacgtttccaaaagcactacgacgagttggcgggccaaaagggcgcttgtcaattgttgagtgaagtaattttgacgaaactgcggtaactggcaaagttgccaatggttttgaaagttgttatgatgtccttaaattaaaaaaataagaaatcaccaccgggtggttggcatttgtaaagctcattaggtctgagaagagctttacagatgccttttttgtttaggaggagactttaatgacgtggatatatttggtagttgccggaattctggaagtggtgtgggccacggcgttgaaaatgagccaggggtttagccaactcggagcaagcatagtgacggtagttggcatgattctcagttttgtctttttgggcttggcggtaaaacacttgccattaagtttggcgtacccgatttggacagggattggggcggtcggctcaattctagtaggggtaatctgctttagggaccgcctcccagcaattacgtggctgtttgtagcattgctagtgagtgggattgttggaataaaggtgacgagtggaaaataaaagagcgcgacaaagcctggtcagctcgtgaggatttctacgaaaagtcaaggatttaaagaaaaataatatattgctataaaaatgaggacgcacttaaataaacctagcggttttaacataattaagggattaatcgcgagttaggcgattgatcccccaatttggttagccgcagagagttggactttttcgcgcgtttcgactatgtagcagtagaacaaataacaacttaatcgtacacaaaaaacgtagcagaagttcattatctaatgaaatctgctcgtttttttgtatcaggttttaaaaaacgagattttgcaaggcacgttggcgactataattaatttgtgaaattaatttcatacgtagcgtctaaatctttaatgaggggtgatagcgcggcctcatagttagaatcggtgaaagtatgacaagtagatttagtacttaataattcgcttactggttttgacaatctagctgcaacaaagggaataggttaatacgtaaagaaaactactttggagggttaagttagatgaatagtgaaatcaagaaacattacaaaatgtataaagctggtaagcgatgggttttctgtggattagccacgttagggattgtagtagggctaaacactgtaaatcaaaacgtatttgctgatacagtaacgcaaactagtccaactacggagcaaacgaatgctaaaacaccaaaatcagccgatgtggacaagtcagcgccacaagtaaaagataatacgacagaaaagcaagccaccaaagttcaaccgactactgcggtcgataatgtcataactaagtcagtatcgcagactgaaaataataagcaaaaagatgtgaacgatgtttcgaaagcggatacaaattccaatacaaagacggacgtaaaggcagattcaaattctaaagttcaattaagtactgaaaatcagccaactgcttcaactacggaagaaccggagaatgcaaaaaataattttgatgagaaaaatagcatggtagatcaagctagtcccgagactaagcaaaacgataaagctacaaatcaagtaagctctgatcaagatgtttcaaagaaagaggattctaaaacaaatttagcttcaactaaggaccagcagaataaagtcgaccaaaaaaagattacaaagtctgatgttaagaaggatgccaaaagtagtagtgataacatcgcggaaggaacttttggaactagtgattggtatattgaccagaataaaacgttatatatcggcggaggagaatttgcaattaacggaagtaacgaatcaccatgggtaacatgggcaaacaatattgaggtaatccactttaaggataaagttaaggccaatgcacaaagtcaaggtttatttgccaatttggataatctaaaagccattgaaggactgaatttattagatacttctgaggttattgatatgcacagcatgtttgattccgatagagcattggcgactttagatgtcaattcgtttgatatgagtaaagttgtcaatattggaaatatgtttgaaagaactggaataactacgttaaacgtttcgtcttgggatacctctaacgtaaccaatatgggaggtatgtttgatgatacgcctcttttaacaatattaaacggcgttaataattggaatacaagtaaagtggtcaacatggcaagtatgtttgattctacggggtttgttacattagatttatcccattgggatactcataatgttactgatatgacggggatgtttgaagatgagtacaatctcaacactattgacgtttcatcttgggatacttcttcggtcgaaacaatggcttctatgttcagttgggataatagtttaaacaatatcataggaattacagattgggatactcaaaatgttactgatatggaaagtatgtttgaagtatcgatttctttacagaacttaaacttatctcattggaacactagtaaagtaacaaatatgaattcaatgtttgaagacgcaatctcgttaaataagctagatttatctagttttgatataaaaaaagatactacacgtacaaatatgctcagtagtctgtctagtttacgagtattaattttagggaaaaacgtcaagctggacggtacaggtttatataacccgttgggtgatgctactaaacgttggattgccgtcgccggcggaactgaagacaaaccattgggggatagaagttatacaggcgaagaactaatggctgtctacaacggtgatatggccgacacttatgtagtagccccatacgaaaccgtcactgatagtaaagatgtcactcaaacaatccactatgtaaaccaaaatggtgtccctgtgctacctgatcatacgcaagtacgtcactatacgcggactggggataaggatttagtgactggcaaaattacgtggggcgcatggaacattgctaatggtgaaaatgcatacttcgatgcagttaaatcaccagacattcagggatacgctccagatatgtcaatgatttcgaagcaaccaattgatgaggcgatgattgaaatgggcggtcaagaaattacggtaacttataatccgattgagttaaagggttcggtaacttactgggacgatgatgaaaataaggtagtcagcacggacaacttaaacggtcattttgatgaggacggttacttcacgattaccgtaccaagtgggtatgaaattaatccaaaaaacaatccgaatggctatacggatggtcaaaccgttcattttacttggtcaacagcggaaggtgcaaatgatttcacgattaatttgagacataagcatgaggcagtcgaccctaatgatccggaagctagcagaactgttacccaaacaattcattatgtagaccaaaatggaaatccaattgcaccagatcatacagcgagtcgtcattacacgcggactggagacaaggacttagttactggccaaatcacctggagtgcatggacgattgcggatggagaaaatggtgctttcgatgcggtcgaatccccggacattccgggatatactccagatatgccaatgatctcgagacagccgattgacgacgcaatgattgaaatgggcggtcaagatattaccgtgacgtatagccccgtagaactaaaaggttcggtaacttattgggatgatgaagaaaataaagtggttagcacaagtaacctagataagtctgctaataaagatgctgatttcaagatcgccgtaccaagtaattacgaaatcgatccaaaaaataatccaaagggatatgttgatggtcaaaccgtgcacttcacttggtcagctaagaaaggcgcgaatgattttacgattaacttaaaatctaaactaagttaaagattaaaaactctatatagtttctaaaaataaataaagatggggatcttcaaatttttgaaaatccccatctttttacgtttctacaatttgcgtaagtacaaagacgccatgtaccaaaaaagcacaaaccggtatcagctcagcttgcgctccaaaattaatttataaagtaccgcgcggattgccatctctaaaggcgagaaagattggacggctttgtcgaggtgttcgatttcgtgattgaaaatgcgcacgaattcgttgaaatgggcttcgacctcgtcggttgccagtagcgatttgatggtgtccaaactaaagctggttttcaaaacgctaatcatcataatcaacgcgaggtgctccgcggtatattttttcttgagtgggtggggcactaagcccatcttgacgtagctgttgatcatggttttggtgacctcggcatgtaaaacgggcgttaggtagcggttggtttcttggatgacctggtccatgtaaagcgccaggtcaggaaattgttggtaatccggtaagcgaagctgcttaaaatcagccaaccactgctggtatttatctgtattcattgcacaaacctccaaacatatcataacataaaccaacatcaaatagataatcattacgctttacgtagaatacaattctatgtataatgaagtcatctaaggtatgtaaatgggggactaaaaatgcaaaaagttcaaagaagccaagtagtttatgaaatatggaacgcgattacccacggggtcgcgtttgtcgcgagcctcgggctagtcgctttgctaattatgaaatcgatttcgaacgggctgccgacgcgggataccgtcagccttgtcatttatggcgcaacgctcctagcgctgtacctggcgtcgacgctgtttcactgccttgcgttcacgaaggccaagcgaatttttcaaattattgaccacagtaacatctttttgctgattgcgggcacttatacaccttattgcataatctttttagaccggcgcatcgggatcatcatgctaagtgcaatctggacgatggcaatcgccggaattatcacccacattttaagcaaggggcgttttcaaaaagtagaaacgaccatctacgtggtgatgggctggttatgtctgctggccgggaagaccctctacgccaacttgtcgccgctaggtttttggctactggttgccggcggggtgaccttcaccgttggcgcgatcatctatagctttcctaagattcccggattgcatttgatttggcacttcttcgtaatggcgggaaccacgttgatgtttatttcgatttacttaaacatttaaaaacttatgaatatttattctacactaaaaagcaaccggaactgtttaaaataacagttccggttttgtttacgatttcattacaaaattaccaaaaagggtaacatgttttaatttgatgtgccccattaatagagtgtgagggtgaactgttaaaacgttttacctaaaatagcctaaaatatttttttaaaaaaattcttcaacgttaacccttgatataacagcgtttatacttgatttctttgtgaaaatacctacttttttagaaaaaattcaatcttaccgtttgacaatgaaccccatgtagaatatcatgtagacattaacttagaagaagctaatacataacattaattaagcataataatgatgtaatgcttccataagttaaaaataatgaaaaatggggggattaaaaatgaataagaatccaaataaccaccgtggcgtggtcgatagtaaagttagtaactttaagatgtacaaggtaaataagcactgggttttcgcttccgcattgatgttatcgatgcttggagcgggaatgatgcagaccgacaccgctgctcatgcggatacagtcaacgaaccgcaaactgaaatggttcataaggttgccgaagcgaaggaagcactgagtgctagcgtaacgccagctaaagaaactacggcagcggcaagcagcgcagcttcaagctcggcggctcccgctaaagcagcacaatcatcaattcaaaatgatagcgcttccaaggtagaaaagggcgcaactgcaagctcagcagccagcagtgcagcgccaactaaggcagcaagttcagcagcggacaagtcagcaacaagtgccgcagcacaacctgaacaaaagaaagccgacgcaccaagcagcgcagcgaaggctgaacaaaagaacgatgcttcagcaagcaaaaatgaacaaaaaactgcaaaggcagatagcgcggcaccatcttcagcagctaagccagcagcagacggtaaagacaacaaagcacaaacaaataattcttcagcagctaaaccagcggacaactcttctgcgtctaactctgacgcttcagttaaaaaagaaggcgtgtccacagatgaaattggaacttcagggttagatacaaatgaccaaaacgacatcaataatgatgccgcagcaaaggcaaaagccgatgctaatgcacaagctaaggataaaaacgcagttgataacaaaaaggttgataaggataagaccgccaaagatcgcgatccacgggcaggagtttctgttttagaagatggaaacctagcgattgatggctctgcagctggtggattgactcttaatgaagacggaacttacgacggaaatctacatttcaagtataccggaagtgcagttgtggcccagattggtgaagattcgaacctaatactgcaaattccgccacaattacgggacctattctctaaaattaatgaaacgggaaattggacaaaatacttcagtggtgatggtaagtttacaattactccgtggcctcttcctagttatacaatcccgtggacctatacgaatagtgatttttcgtatgacggaagcacattaatactaaaaaataggagagtagaccttgctattgaacagaagacaaccgaaatcaatcttaacttcaatattggtcaagcagttaccgactttaaagaacagattgataatgctggcgataactatacatttagagccgcagtaattgaaccaacagatattatcgactggcacccaattggtgactacgcgggtgttgcgtcattaaatactagtcatctgatgccgacacgggacgaattgaatccaccaaccgttaatcaaccggtttatgataatactacacgcttacaggtaagggtgaaccaaatgctgaaattgtaattacgttacctactggcgggacattgcgtacccataccaatgaaaatggtgactttagtatcgccattccagcacaaccagctggaagtgaaatcagcgtttcacaaaatgttaacgggcaaaccagtgatgaggttaaagtacctgttcagaaagctccagaagtgattgaaaagccaggcattgacgcaccacatgcgggcagcaaatatgtaactggtacggggattgctggagacactatccaagtttacatgccaggtgtaggcggtggtgaagatgtgatgattggtactacaactgttggggcggatggtaaatggagagccgctatttcagatcagtataatttagtcgaaggcgaaagcatttatgcggtacaaattaaaggaaactcgcgaagcgacaagcagtacacaacggttcttggagaaattcacgttgacgcaccaatcatcaatccgattgcggaaggtgacacggtcatcaccggaacgggtgaacctggagatgaagttacagtttactttgatgatggtaagaataatagtgtgattggttacgcaactgttgaggccgatggaacttggacagtggacgctgggcatgtaagactagttgatggagatgtagtttctgcagctcaaactcgagatggagtaactagtgacaaagacacggtttcagtaaaagccagagaagtagttgaaaaaccagttatcaacgacattacggaaggtgacaaagtcatcaccggtacaggtgaagctggttccgaactcagagtatacttccaagacggtgacgtccaaattggacaaaccgtaatcgttcgcgctgatggaacttggacggtcgatgctagtcactataacttgaccaaaggtacggttgtatacgccgttcaaactcggaataacgtcgacagtgaacgtgcttacagcaccgtaaagggtcatgaaaatgttgttaaaccaggtatcaacccaatcagggaaggtgaccaagtgatcaccggaactggtgtagttggtgatgaaatcagcgtatacttccaagacggcgacgtccaaattggacaaaccgtaaccgttcaagccgatggaacttggcaagtcgatgctagtcattacaacttaaccgaaggtacaatcgtttatgccatccaaagccgtgacggaatgaacagtgaaaaggcttatcaaacagtacttcctaagccagaagaaatcccagccccaacgtttgataacgtgcgggaaggcgcaaccactatcacaggccgaggcgaagctggcgacacagtttatgtttacgtgaagggaacgaacggcggtgatgacatcttggttggccacgcaacagttagagctgatggaacttggtcggtagccactggacgagttagcgtctacgaaggtgaccaactctacgcttatcaaaccaagggcgaccaacaaagttcaaatggtacgactacggtgcttcctaaacaagaagagattccagccccaacctttgatgaagtaagagaaggcgcttctaccatcacaggtcgaggcgaagctggcgacacagtttacgtttacgtgaagggaacgaacggcagcgatgacatcttggttggccatgcaacagttaaggctgatggaacttggtcggtagctaccggacgggttaacctcttcgagggcgaccaactctatgcttaccaaaccaatggcgatcaacagagttccgatggcactactacagtgcttcctaagccagaagaattgccagccccaagcttcgatgaagtacgcgaaggtgcttctaccatcacaggtcggggtgaagcgggtgacattgtttatgtctacgtgaagggtaccaacggtagcgatgacgtcttgattggtcacgcgacagttaaggccgatggaacttggtcggtaaatactggccgggttaacatcttcgaaggcgaccaactctacgcttaccaaaccaatggcgaccaaaagagtccgaatggaacaactacggtacttcctaagccggaagaattgccagcgccaagcttcgattaagtacgcgaaggcgcttctaccatcacaggtcgaggcgaagctggcgacacagtttacgtttacgtgaagggaacgaacggcagcgatgacatcttggttggccatgcaacagttaaggctgatggaacttggtcggtagctaccggacgggttaacctcttcgagggcgaccaactctatgcttaccaaaccaatggcgatcaacagagttccgatggcactactacagtgcttcctaagccagaagaattgccagccccaagcttcgatgaagtacgcgaaggtgcttctaccatcacaggtcggggtgaagcgggtgacattgtttatgtctacgtgaagggtaccaacggtagcgatgacgtcttgattggtcacgcgacagttaaggccgatggaacttggtcggtaaatactggccgggttaacatcttcgaaggcgaccaactctacgcttaccaaaccaatggcgaccaaaagagtccgaatggaacaactacggtacttcctaagccggaagaattgccagcgccaagcttcgattaagtacgcgaaggcgcttctaccatcacaggtcgaggcgaagctggcgacacagtctacgtctacgtgaaggggacgaacggcagcgatgacatcttgattggtcacactacagttaaggccgatggaacttggtcactatctactggctgggttaacctcttcgaaggtgaccaactctacgcttaccaaaccaatggtgatcaacaaagttcaaacggcaccactacagtgcttcctaagccagaagaattgccagcgccaagcttcgatgaagtacgcgaaggcgcttctaccatcacaggtcgaggcgaagctggcgacacagtctacgtctacgtgaagggaacgaacggcagcgatgatgtcttaatcggtcacactacagttggtgccgatggaacttggtcgatagctaccggacgagttaacctcttcgaaggtgaccaactctatgcttaccaaacgaacggtgatcaacaaagttcaaacggcacgactacagtgcttcctaagccagaagaactgccagccccaacgtttaacgacgtaaaggaaggcgacactactatcagtggacaaggtgaagccggcgacacagtctacgtctacgtgaagggaacgaacggcagcgatgacatcctgattggtcatactacggttggtgccgatggaacttggtccttatctaccggccgggttaatatctacgaaggcgaccaactttacgcttaccaaactaacggtgatcaacagagtccaaatggtactactgtagtacaacctagaccagaagaagttccagctccaacgtttaacggcgtaacggaaggcgacaccaccatcagtggacaaggtgaagccggcgacacagtttatgtctacgtcaaaggaacgaatggcgctgacgatatcgtaattggtcacaccacggttggtagcgacggtacctggacactcagtactggacgagttagcttgttcgcaggtgatgagctccgtgcttatcaagttagaggtgaccaacagggtcctgaaaatagtacaatcgtaaaggctcaggaaaccttagatgcaccagggatgaacgacgttacggtaggtgattcggcgattactggaactggtgaacctggcgcaacggttaccgtaaccgtcgggggcaaagagcttccatcagtaacggttgatgaccaaggaaattggacggttgacaccagcggggtaaccttaaacgaaggtgacgaagtttcagcaacccaatctaaagacggagccactagcgacccaaccactaaaaaagtccaacctgcaaaagaagagataccagcacctggagtagatgaaatcaaagcgggagccaaagctattagtgggataggaagtaccgaaggaaacacaatcacagcctacttgttaggtgacgacggaaactgggtgaagattaaatcaactacggttgactcatttggcacctggacaattgaattgccagatggcactgtattgaaggctggcgatacagttcgagtaatcgaaactagccctgatggtaacgaaagcaaaccaactgatgttgttgtaggttaagcaatgaaaaagttataactaacgaataagttttatgggggagtaaggaagctaggaaacgatttccacaaggaatcggtttcctagcttttttgtgttcgaataattatgttgaatcgtttgggcaagtgacgcgcacctccggtaaaccaattgcgaagaataaaactaagctgatttgattcatctcatatcagttgacaagcaaccccataaagattattatgaaagcgttaacaagtatcaaaaacgatgcacgcggtagattaaagttaacgaacgatttcaataactttaaattaatgaaaagaggaggcttcccgatgtataaaggttttaaaaagtatttcagcaacggagcggatcgcaaagctggtaattatccggtggctaagcggaataagcgctggctccttgcttccgcagtaatgctggcaatgctcggggcgggcatggcgcaaccccacgcttctgctaaggcggctgaggttaacgcgtcccgcaccgaaactatgaccaaggctgcagagtacactaaggcaccacgacaaggtcgaagtcgggggatggcgaattctcaaaatcttgataaaacaaaaaccgtcgcaacgcagaaagccaacttaactagtgctttagaaaagggtaatttaaacattactggcggcgcttattatggattagataaaaatggcgatggcacgtatagcggcggtctgcaatttaattattcaggaagtagtacggttaaatttgaagactcaaatttggtaatccaaattccagaaccgctccgcagtttatttaaaaaaattaatgagtcggacagttggggaaaatatttcaatggaaacggtaattttaatacgggaccgatggaaaaaatatggacttacaaaaacgaagatttctcttatgacgggactaatttaattttgaaaaatggtaaggcaatctcattaaacggatataaaaagacaaccattttccttaatttcaacctcggccaagcagttaacgattttggggaagcaatccccgattctaccgataactacctaatttaaaacggcattagttgatccggaaaatccaattgattgggacttgattggtaatgatgcaggaagccacgcattgggaacgaaccatatcatgtatcgctaataaggagctacgaaatagtgtcaaatttaaaaaagcactttagaatactgaacaataaaaaggtgagaaagtccggaattggagctttgaccataggaatcacgctgttgggcctaagcatcggtcaagtacaggcgtcaataaaggcggctcccaagaatggattgcataccgaagtggcgcaccaagtttccaaaattggctccacgggggtacaaaccagtttagcgcaaaatggcagttcgcttaacgcagctattcaagatgaagttgcggatccgacctttaacgtggtttgagaaggagatccggtaatcaccgggactggcgagccgggcgcggaaatcaacgtttttaaggatactccgactggtgcgccactcttgattggtaacacaacggtggacttcctcggcgggtggctggtagatgctagtcaacaggatttgcgcgcgggggacgtgcttttcgcctaccaaggggaaggcgctcaagtcaagggcactcaaactacggtagaagctaaacaagcagaggtgccgcgccccactgtaaatccagttaaagcaggtgcgcaaaatatcactgggcaaggcgaacccggtaagataattaagatctatctaaaggaagctgacggaagtaaccggccgctgggggctgaaccggtcgaccaatttggaaactgggtagtccttgtgccgattaacgttgagctagaagctaacgacgtacttgaggtttaccagagcacgcttgacgatgtgctaagtaagcctgtccaagttacggtaaccgagtaatgaaaaagttataacgaacggaatactttatggggataaagagctggggaacgatttcgatgaagaaatcggctttccagctcttttttttgcgtgccttacccttatttgtgtcgagatttaactaaataaagaaaaaagtgagaataaaaagcaacgttaacggtgtaccttaaggctaagtataaaattaaatagggtttactttaaaggacggtgatggttaatttactgtttttttgttgattatcgttggataaagaatcactatcggtaggatccgtgcaaaagcaacgcataaaacaatccctgattagttggcaatatagaattagcgagtgacaggaaccatagtggtgtcaaaaatgtggaggtattttacacaatgatataccccgtcgacattgtagcctatcgatttttaataaatggacctggtttgctaaaaattgggaaactaaggagataaattacaattacacttttaggtgaggcgagtggcctacttacaaatacggaaaggagtggctttagatgtccgagacggtaactaccatgagattgcagaagaaggatccgggatttttaaacggtttttgccgtcgcggaacctacccgtccggcttcgcgatcgccaggacgggatttggttgaaattggtaacgataaagtttatttctctaagtgattcaacactgggcaagtacagtttaagtaggttaggtaggggtcaaaattaacgaccagcactactgcaaaaggcgaaaacgatttcctgtttagctacatagagaataaaaagggaattgcctaattaataatggaggaagttaatgtctaagagaaaaatatggaatgttaatgagaaaaagcattacaagatgtacaaaagcggtaagcagtggttctttgccggaatgggaatcgtagccggactttttggtgcaggatccaccacgattgccagcgcggatgagacgcctaagggagcaaatctcgaccttagtaagtctaagaacctcctggcgaccaagacgagcgcgacgattccgggctcgacaagtaacacgaattcgcaaaatgttaattcgacgcataacagcgttacaaattcggcttcgaccgcaaatcaaaatacgcaagcaagcgctagtcagtcagccagtaaggccgcttcggctagcttaagtgcgtctttaaaggcttccacaagcagcaagccaacaaaaggctagtcaaagtaagagtcaacaagcggctgaccaagccaaacaagctagcgaaaaggataaacaacaggcagctaagacggatactaaaaaagcatccaacgttaacagccaacaacacagccaggctgatagtcataaagattctactaaccaacaatctaaatcggtaacgaagcaaagtacgaacaacggtagtcaagctaacgctgaaaatcgccaggattctacttccgtgaccggttcaaatattaaaactgaaaccagtcaaaacgatatccaaaactcacagagtttatcaatcgctaattcagttgcggattccgttaaacaaagccagtcgttagtagcggataagcagtcgctgtcgattagtcagagcatggtagcttcaatgtccaagtcgacggaaaaaatcacttcgaagtcaggtgatcctgaagctccgattcaacacgagaatcaatatttagacgagaaaacaggggcatcactacttcctacggtggatgattatcgggatactgaggatgcactaaaaatttcagcgccgcctacgatcccgggatatattctagatataacccgaatagacatggcattccaattggctggcgcacatcggccatccagtcaggcaatggtggattacttggctgagtttaggaagtacgctgcaacaggtgcgggtagtatcgatgatcttaacgcgtggattagaaacagtgacttttataagcagtatttggatggttcagatccagacgtaacgttagtatcgcttcgagtgaaatggctctttaaagagcatgatagtgaacttaatcttgtaggacacgatgttgaaacgtcggttgggaatccacttgaacctaaggatgcggttacgagcattaccaatgctgacggaacacatcctaacttggatgaggacattccgggattaagctggaagggttatataaattggaatcaacgtggtgactatgacgtaacgcttgtttactatgatgctaattcgttacaaacggtatatcagccgattgtggtacgcgttacttcgaacattgcacttgatgtcaaggacggtcaaacatacgtaggatatcctaaagatatcagtgatttcgtaaatcagattactgatggttcaggaaatgatattagtcctacagatcctaacactaagcttcaatggggcatgcgtgatagttggtgggatgaagctaatgtctacaaaaacattgaaattacgtatacagatagtaagaccggcgagacaattactaagaccgtaacaatcacagttttaagaaatcaagaagatattaagggtgaaggtacaacctacacaattggggacaaacacccaacaattaatgatctgaaaccttcggcacataaagctaatggggatcttgacacagatgccacacactttaaaacggatatggaaggggaagttaaatgggataccccgggtacgtacgacgttgaaatttcatattatgatgacgtaaccaaaggaaccataacaactacggttaaggtaacggtagtagctcaagaggataagataagtattgatggtgagggaacccaagtaaaagttggggacaagccaactctaaaggacctgaatgctcgcgcgacggatcataatggaaacgaagtcgatattaatgacatcgattcggatatcgacaaaatcgattggaataaacccggtgagcacgatgttgttttaacttacacggataacggtgagacggtaacgaaagttgttacggttacggttgtaagcgaccaagctctgagcgttcaagatagcgtagacacttgggaaggccagccattaaacccacaagatgttgtgactgggcttaccgattcgcatggcgacgttgataatgacttaactaacgcatggtggaaatttgatgataaaaactgggacaaaccagacacatatacagtaacggtttactatacagataagtacgggaacacggtttctaaagacgttaccattgtggttaaggaagacaaaacttcgattgatggtagtaattatgaaactacgactggtaacataccgactctcagtgatgtaaacgctagtgcgaccgacgctaatggcgatccagttgatctatcagaaatcaaagctaccgttgaagacaccccttgggatgatgtcgattggtcagtacctggaacttatgtagttactttgacatatactgatccaactacgggtaagacagtaaccaagaccgttacggttacgattaaggacgacgttaatagtatcagtcaatcagaatctaacgccgactcagtttcgaagtccggttctgattcagtttcgaagtcaacgtccggctcggattctatttcgggctctggttcagactcaatctcgaagtcaacgtccgattcgatttctaagtcgacatctggctcggattcaatttcgggctccggctccgactcgatctcgaagtcaacgtctgattcgatttctaagtcaacttctggctccgattcgatttcaggctccggttcagactcgatctcgaagtcaacatctgattcggtttcgaagtcgacgtccggttctgattcgatttcgggctctggttcagactcgatctctaagtcaacatctgattcgatttctaagtcgacatctggctcggattcaatttcgggctccggctccgactcgatctctaagtcaacgtctgattcgatttctaagtcaacttctggctccgattcgatttcgggctccggttcagactcgatctctaagtcaacatctgattcggtttctaagtcgacgtccggttctgattcgatttcgggctctggttccgactcaatctctaagtcaacgtctgattcgatttctaagtcgacatctggctcggattcaatttcgggctccggctccgactcgatctcgaagtcaacgtctgattcgatttctaagtcaacttctggctcggattcgatttcgggctccggctccgactcgatctcgaagtcaacgtctgattcggtttctaagtcaacttctggctcggattcgatttcgggctccggttctgattcgatttcgaagtcaacgtccggttccgaatcaatctcgacttctggttccgactcgatctcagcatctggatccgactcaatttcgaaatcaacttctggttccgattcaatttcgggctccggttctgattagatttcgaagtcaacgtccggttccgaatcaatctccacctctggttcagactcagtttcgggctccggctctgactcaatttcgaagtcaacgtctggttccgaatcaatctccacctctggttccgattcgatttcgggctccggttctgattcaatctcgaagtcaacgtccggttccgattcgctttcgacctctggttccgattcgatttctaagtcagagtccggttctgattcaatttcggcctcgggttcggattcgatttcgaagtcaacctctggttccggttctgattcggtttcagcttccggctctgattcaatctcgaagtcgacctctggttccgattcgatttcggcctccggttctgactcaatttcgaagtcaacgtctggttcggattcgatttcgaagtcaacttcgggttccgaatcactctcgacttccggttccgactcgctttcgaagtcaacgtcaggttctgattcaatttcaacatccggttctgactcaatttcgaagtcaacgtcaggctccgactcgatttcgaagtcgacttctggttccgactcgatttcggcctccggttctgattcgatctcgaagtcaacttctggctccgaatcactctcgacctccggttccgattcaatttcgaagtcgacttctggttccggctccgattcggtttcagcttctggctccgattcgatttctaagtcaacttctggttccgaatcgatttcaacttccggctctggttcggactcaatttcgaagtcgacctccggttccgactcgctttcgaagtctgattctggttctgattcgatctcgaagtcaacttctggctccgaatcgatttcaacttccggctctggttcggattcgatttcgaagtccacatctggatctgactcgctttcgaagtccgattctggttctgattcaatctcgaagtcaacctccggttcggattcgatttcagcatctggttcggattcaatttcgaagtcgacgtctggttccgaatcgatttcaacttccggctctgactccatttcgaagtcgacctctggttctggttccgaatcactctcgacttccggctccgactcaatttcgaagtcaacttccggttcggactcgctttcgaagtctgattctggttcggattcgatctcgaagtcaacgtccggctctgaatcaatttcggcctccggctctgactccatttcgaagtcgacgtctggctctggctccgaatcactctcgacttccggctccgattcaatttcgaagtcgacttccggttcggactcgctttcgaagtcagcttctggttcggattcaatttcgaagtcaacgtctggctcggattcaatctctggctccggctctgattcaatttcgaagtcgacttctggttccgaatcactctcgacttccggttcggactcgctttcgaagtcaacctcgggctcggattcaatctccggttccggctccgattcaatctcgaagtcgacctctggttccgaatcaatctcgacctctagctcagattcggactcgctttcgaagtcagcttctggttctgattcgatttctaagtcaacgtctggttctgactcaatttcgaagtcaacgtctggttcggactcgctttcgacttccggttctgattcgatttctaagtcaacctcgagttccgactcgatgtccaagtcagcttcgggttccgactcaatttcgaagtcaacttctggctccgattcaatctccggctctggttcggactcgatttctaagtcaacttctggttcagaatcgctttcgacctcgggctcggattcaatctcgaagtcaacgagctttaaggatgttaaccgagttgttagcatccttttatgctataaagccaagccaatgccggcttagctcagttggtagagcggcggtatcgtaaaccgtaggtcaggtgttcgactcacctagccggcattatggaatacgccttaatgttaaagttaaggcgtattccatatatagtcccaagtttatagccttaagtattattttgattaggcgagaattatggagaaaataaaaattgaatacacaagaaaaagatacagcttttcttggtcaaccgcgtggtttgatgaccctgttcttcacagaaatgtgggaacggttcagttactacgggatgcgtgcgatattaatttattacatgtattacgcagtttcacaaggtggactaggttttagccaagctactgctgcttcagttatggccatttatgggtcgttagtttatttagctagtgtcgctggtggttttatcagtgatcgtattttaggtagtcggaagaccgttttctatggcggggttttaatcatgtttgggcacattgctctttcattgccattcggtagcgcggcattacttgtgtcaattgcgctaatcgttatcggtacagggatgttgaaacccaacgtttctgaaatggtcggttcgctttactctgtagaggataccagacgggacgcaggttttagtattttcgttttcggtattaatttgggcgcgttgctggctccgctaattgtttcgtgggttggtttccaaatcagtttccacgcaggcttctcgttggctgcaattggaatgttcttcggactggtgcaatattatcttgatggtaaaaaatacttaaataaggatagcctctatccttcagatccaattcaaccagaagaagttaagaagtttagcttacgcgtacttatcggcgtggtagtgctcgccttaatcttgttggtaatgttcattgccaacgtgcttacaatcgataacgttgttttattaattagtattgtggctattattacgccagtggtttactttattttaatgttcactagcaacaaggtttctaaaggtgaacgttcccgtttgtgggcttatgtaccactctttatcgccgcaaccttattctgggcaattgaagaacaaggttcagttgtattggcattatttgctgcagatcgtacccaattacattatggatggattaacatcacgccagctaacttccaatcgttgaacccgttgttcatcatgttatacaccccgatctttgcttggctatggactaaattaggtaaaaaacaaccttcgtcaccgaagaagtttacctatgggttagtatttaccgggatttcatatctcttcatcgcgttaccaggcttgatgtttggtactgatggaaaagttaacgccctttggctagtgggtagctgggcaatcgttggaattggggaaatgttgatttcaccaattggattatccgtaactaccaaattagctcccgcagcgtttgcttcacaaatgatgagtatgtggttcttggcaaatgccgctggacaagcgattaacgcacagctggttaagctttatcctggtcacgaagttagctacttcatttggaccggaatcattacgattatctttgcggttgctttatggttactttcaccatggatcagcaagaagatgcaagggattcgttaataaaatttgaatttacaagatgaactaggttatgcttagttcatcttttttatttaggataagtcaaacgagtaggggcgaacgttttgagagtagcaatgactagtgacaatcatttggacattaataaggttgatattgagcaaacgttggcaacgcaagcacaataccttaaagacaatcacgtgggaatttatttaattgcgggagacttatttaataagttcaaccgtagtaaggaatacgtggaaaaattacagcgccgcttgccacggaccaaggtgttctttattgcgggaaatcatgatatgttaaatgacattgattacgctgggttagaaaagctgcaacacccgcagtacctgcacaaccaattttatgacgttccgggaaccaaatggcgcatcattggaaataacggctggtatgattatagttttgcggataacgtagataaaactcctgaacaattttggcggtggaaaaaaactttttgggtagatactgcgattgagcagccaatctctgacattgaacggatggatcgcgtactgcaacaaacggaacgacaacttcaagcagcccaatctaagtcagtactttttatgacccattttgcagtgcgccacgaatacattcgctacactgatgactaccgcttttggaacatggcgaacgggatgatggggagccgccgaatggaaaagttattatcaaaataccagccaaaaattattttatccggacacctacattttcactataaacctcttgcaacagctggcgggatatattataatagttcagtcggatatcataagagacgaatcaacgagtggaattcggataattttattactgaatggactcagcgattacttataattgatcttgaataaatttaaaaaaagtttcaaaaaagcttgcaaaattcttcaagattagttattataattaagtcggatagataagacgacaacttatatggaagggtagcgaagtctggctaaacgcggcggactgtaaatccgctccttcgggttcggtggttcgaatccactcccttccaccatattgggctatagccaagtggtaaggcaacgggttttgatcccgtgatgcgctggttcgaacccagctagcccaatcagttaaactccatgtcgatgacgtggagtttttttgtgcgttcatttatggctaaattgtctgtaaaagtggttatctagttgataagcattctttaattagaagactaagtagttatcgtaaatttgatttttttgcggatcttagaaaacgctttcacaaaatacccgttagtattataatgaaggtggagcaactagtcttttaatgtagtaaggaggcaattaaaatgcgtgcagcggtagttaggaatcaaagtgatgggtacgttgatattgtagaaaagcaattacgaccgcttagggacaatgaagccttagttgacgtagaatactgtggggtatgccatacggacctccacgtggcaaatggtgactttggcgaacaacctggacgggtgattggtcacgaaggaattggcattgttcgcgaaattggtgctgacgtgcacagcttaaaggtgggagatcgggtttccatcgcctggttctttgaaggctgcgggcattgcgaatattgtactactggacgagagactttctgtcgggaagctaaaaatgccggatacacggttgacggagcgatggctgaacaggcaatcgtcgtggcggattacgcggtgaaagtgccggacaatctggatccggtggcggcaagttcaattacttgtgccggcgtaactacttataaagcaatcaaggaatctaaaattcgtcctggagaatggttgacggtgtttggcgctggtggattaggtaatctggcaattcagtacgctaagaatgtgtttaacgctaaattagcggtggtagacattaatgatgataaattggcgctggccaaaagctgggtgcggatttggtaatcaattctagcaaagaagatccggcgaaggtaattcaggaacggtgcggcggagcacaggcggcggtagtgaccgcggtagctaaggcagcctttaacgcagcggtcgattgtctaaaagcaggtggcgttttagttgccgtagctctacccgtagacacgatggatttatcaattccgcgagttgtattagacggtattcaagtaattggttccttagtcggcacccggaatgacttggcggaagccttccagtttgcagcggatggccaagttaaacctattgttcaaactcggcgtttggatgaagtgaatgacatcatcgatgaaatgcgggctggacaaatcgaaggtcggatggttgtggacatgcataaataaggatgatggacacgtaactttaaatgcgggagtgtcccccaaatgcctgatagacattaagcagtggtaagaccagcttttaagggtccgtaaggatgaaaaatcaaggctgattgaaaaagtcggctagtttttgagtattaactgaaattcgaccattatgcctgaatttggcataacggtcgtttttaggttgtgcggagcataatggctttggactttattaaagccggcacccctaaaatgatttttttctcagtttcagtcacgtttttaactgcatcatgatactttggcaagggcgttggatttgctcgagaagtattaaaccttcataaaatattacataattcccggggatttaatgataaaattaaaataattaacagagaagcgggggaatacaaatgaaacttggatttattggcgttggaaacatggccaaggcaattattagcggattagtaaagaaagatgtcgctggtaaggatattttggtccacagcgctcacccacaaaactacgaaacttttgcaaaacaacacggactaaccgcagtatcagataatacggcggtagcccaacaggcagacgtaattattttggcagttaagcccacggtgattaagcgggttgctgaagaaattcaaccggtactaactgaagaaaagttggtggtttcaattgcttctggcgttagtttagcggacttacaagcggttttaggcactgctcaaccgattttgcgagtaatgccaaacgtaaacgttgaaattgcgcaaggaatgacagcggtcaaagccacgggcgaccttaacgcagctccgtaccaagcgggagttgagttgtttgctcggatcggaaaaaccatggaagttgccgaaaatgactttccgattttcgcggcacttgcggggagcgcaccagcatatgcttacctatttattgacgcgctttcccgggcgggcgttaagtacggattgactaaagctaacgccactaagattgctgcgcaaatggtacaaggcagtgcgcaaatggtgctcaatagtgatgaagtgccttacgcattgattgataaagtttcttctccaggcgggacgaccgtcgcaggtttattagcaatggaagaagctggatttagcccagccgtagttaagggaattgacgcaaccatggcaaaagaaaacggttaaggtaatcttgttttttggtctataccgatatataatgaagctagattaacttagaggaggaaaattcatgagtacagttttacgacatgcgacaatttatacgggcctcgaaaagattgaagacggctacattcggtttggtaagaccatcgaagcagttgggccaatgagtgaatataaggcacagggtgacgacgaagtttattacgcagggggcaagattattgttccagggttcattgacgtacatacccacggtggttacggttttgatgcgatggatggcgatccagaacaaatcaacgaaatggtaaaccaagcggtaatcaacgaaggagttaccagcttcttttgtaccacaatgactcaatccaacgaaaacattgaaaaatcaatgcgcggagtggccaaggctgcggaagaaaatcccgttatccaaggggttcatttggaaggtcccttcatttcggcgaagtacaagggtgctcaaccagaagagtacattaaggacccggacgcagcattacttggcaagtggaacgagctttcaggcggtcgagtaaaattaattacgatcgcccctgaacacgcaggctccgatgcatttgaagcatactgcttggaccatggaattgttccttcagtaggacattccaacgctacccgtgcacaattgctaaatagcacggttacccacgcaactcacttatacaacgcccaacgtgaatttaagcatcgtgaaccaggggttaccggccacgtaatgttggaagacaacatctatgctgaattaatttgcgacggtttccacatcgttcctgacatgctcaaactggcttatgaagttaagggaccagaacgcattgaattggttactgactcaatgcgtgccaagggaattgccgaaggagaaagtgaacttggcggacaaaaagtttacgtaaaggacaagcaagctcgtctagctgacggaacgctagcaggttcagtgctatcctttgatgatgctttccggaacgccatgaagttctttggttgcggaattgcggaagctgttcaaatgagttcggtaaaccaagctcgtgaatttggcttagattctaaaggaaccttagaagttggcaaggacgctgatttaaacgtctttgacggcgaccttaacaagttagaaacttacagctacggcaagaagtttgctaaggaagattaatagttaaaaacaagtaggagtacaatcatgaattcaccggtatatattcagattcataatgaaatcaaaaaggcaattgaagcaggaaaatggaaagttggtgagcggattcccgccgaacgggaactgtcaaaccattttaaagttagccgaatgactttacgccaagcgatttcaactttggttgatgaagggattttagaacgtaaggtgggttcggggacgtacgttgctagccaaaaggtccaagaaaaagtttctggagtaaccagttttacggaattgacggaagcccagggtaagaaaccatcgagcaagacaatttcctaccatactagtgagccatcgttaagtgaaattgaaaaattaaagttagcggatggagatttagtactccgaatggaacggatccggtatgcggatggggtaccgatttgttacgaaacggcgaccatcccagaaaagttagttactaactttagtaaatccgaagtaactaagtcgttgtacaatactttggaagagcgtgcgggactggtaattggtcgtgctgagcaaaccgtatcggcgatgttagcttccgaaaaggttgccgaataccttgacgttaagcggggcgcagcgattttacgccttcatcaggtttcatacgcccaggatggtacgccatttgaatacgtacgaacgcaatacgtaggagaacggtttgaattctatttaaatcggtaaataattggtgaggaattgagaagagggctacccttaattccaaagtcataaaaacgaggattaggttctttttaagaacgctaaccctcgttttttgtgttcgtcgttatttgcggttggcccaccatgctttaatcataaagattggaagtacgatttggcgtttgatccggcggggatcgctgattaaacggtatagccactctaggttatgcttttgccaaaattcgggagcacgtttgacttctccagcaaagacgtcaaaactgcccccaatacccatccaaattgcgggagagaggtgccgatacttttggattaactcctcttgtttggggaagccggtggctacaaaaaccatttccggctgggtttgctcaatttcagtttggatgggagcaaaatcggtaaaatacccatcatgatggccagcgacttccacgtggggatattggcggttaactttggcaatcacttgagcaatcacggccggtttgcttcccaaaaagtagattcgcgaatggtgtgcgtctccccaacgcaaaagttcttcaaaaagttcgtagccggttacgcgttcgggcagcggatgggcggtatgctgggttgctttcacgacgccaatcccatcagcaactaaataatcggcttggcgaataatttcagcgtaagcgggatgttttttagcgtacataataatttctggattagcggtcaccacaaagcggttttggtgggccgctaagtcggtatgtaatcgttctaagaattgggccttggtcgtttgtaaaaaattgaatcccaagacgttggcagttgaaaacttcatatataaaggttctcctcacgataaaattgcggtttggcgcaaaaatgataaaattaaagcaattgtattttatgtccaccagtaaaatttatactttaaaaaataaagagtaggagcataatcatcatggtacaagaatatccagatgacacattaactttacacacagacgcttatcaaatcaacatgattcaaacttattggcaaaagggaattcacaatcaaaaggcaatttttgaagttttcttccgtaaaatgccttttgacaatggatacgcagtttttgccggattagaacgggtgattgactatatcgaaaaccttcacttttcggcgagtgatatcgaatatcttcgcgaagtgggcggctatccggatgattttctggaatttttaaagaattttcatttccgggggaccattcgctcggcagtggaaggcgacctagtttttaataacgaaccaatcttacaagtcgaaggaccactggccgattgtcaactggtggaaacggcaattttaaacgtggtcaattaccaaaccttaattgcaaccaaggcggcgcggattaaatccgtagttggctcagacaagcttttagaattcggcacgcgccgtgcccaagaatttgacgcagcaatttggggaacccgggcggcttacatcggcggttttgacgcaactagtaacgtacgggctgggaagaagtttgggattccaattagcggaacccacgctcacgcaatggtgcaatattacatgaacgactacgatgcgtttaaggcgtacgcaaccactcatcacgattgtgtctttttggtggacacctttgacacactcaaaagcggggtgcctaacgcaattcgggtggctaaagaaatgggcgaccggatcaatttccttggggtacggatcgatagtggtgacatggcttacctgtctaaacgagttcgcgaacagttggatgaagcgggttatccaaacgctaaaatctacgcttccaacgatttggacgaaaagaccatccaaaacttaaagatgcagggagctaaaattgaagtttggggtgtgggaaccaaattaattaccgcttatgaccaaccggcgttaggagccgtttataagatggtttccattgaacgggacggaaagatggtcgacaccatcaaattgtctaacaatgctgaaaaagtttctacaccaggcaaaaagcaagtttggcgaatttctcggcgggcagatggtaaatcagaaggagattacattacgctttgggatgaagaccctcgtgaaaaggattcgctatacatgttccaccccaactatacgtacatcaataagacggtgaccgattttgaagctcgaccgttattacaaaccatttttaagaacggcaagttagtttatgatcgcccatccttagcggaaatcaaagaattttctcggcaaagtttggattccttgtgggatgaatacaaacgtgatttaaatccacaagactatccggtggatctttcacaagaatgttacgatcacaaggtatccatcattaagcgggtccgggattacgtaaatcagcttaaattttaatcattggggggcgtaaaaaatgcgcaaaatgcaacaagaaattattgaagctctacgggttcaaccaacaattgacccagaaaaagaaattcgacgcagcgttgattttatgaaacgctacctaaaaagtgttcctagtttacgttcgctagtccttgggatttccggcgggcaagattctaccttagccggagcgttggcacagatggcaattcgggaacttcgggaagaaactggcaatgccgattaccaatttattgcggtccgcctaccttacggggttcaagctgacgaatcggatgcgatgaaggcaattgaatttatgcaagcggaccgggtggtgcgaattgacatcaaaccagccgcggatgccatggtagccgctattgaagcaaccggagttcaggtatccgattttaacaagggaaacattaaggcccggcaacgaatgattgcccaatacggcatcgcgggtgaaaccgcgggaatcgtggtgggaaccgaccacgcggccgaatcggtgaccggattttatacaaaattcggggatggcggtgcggacatcgttccgctatggcgcttgaacaagcggcagggtaaggcaatgcttaaagcgttaaacgcgcccgttgagctttacgaaaaggtgcccacggcggacttagaagatgaacgaccagcattaccggatgaggttgcgttaggcgtaacttaccaagacattgatgattatctagaaggcaaggaagttagcgacgcagcggccgaaaaaattgaaggttggtaccaacggaccgcccataaacgtgctttgccgtataccgtttttgataaataaattgttaagttcaaggctcgtcacttgtaaaggaaaattaatttccggtataatatgtttaaacatgagggagtaacttgcagcttagctgtggtaatgtcatcagcaagaaaaaatctggtattaccttaaattagtgagactcatgtgtgtcgagaagtagttttcgacgcacatgggtctttttttaaactttaagatcccaattaaatggaggaaagagaatgaaggcaagtaagttaaaggattggcagcggaccgttgaagataccgctgctaagcaagatacccggttagctgggctcacgactgccgaagcacaacgacggttggaaaaatatggccataatgaactagcaactaagggtaaaacgactttgttacaaaagtttttggcccagtttaaagatttgatgatcattgtgctgctcgtggccgccttaatctcagtgtttgtgggcgaaggagtcgacgccttgattatcttgctggtggtggtgttaaacgcaatctttggcgtttttcaggaatctaaggcagaagaagctattgatgcattaaaaagtttggcagctccgcaagccaaggtcgaacgggacggccaaattcagcaaatccagagtaccgaattggtgccaggagacgtggtcattttagaagctggagacgtggtgccggccgatttacggctggtagagtcagcgtcgatgcaaattgaagagtcggcgttaacgggggaatcggtcccggtgaataaacaaacggcggccctagatgacgaacagcttcccctaggcgaccgtaccaacctcgcctttatgaatagtaacgttacttttggccgcggaaagggaattgtcattcatacgggaatggcgaccgaagtagggaaaattgcccggttaattaacgacgctgatgaaaccattactcctttacaacgtaatttaaccaagctaagtaaaacgttaacttggttaattttggccattgcggtggtggtgtttgcggtcggtatgttacggggccaagaaagcttaatcgacatgttgttaaccgcaatttcgcttgcggtggcggccatcccggaaggtttaccggcaatcgttacgattaccctagccttgggaacccagcggatggttaaacggcacgcaattattcgaaaactcccggcggtggaaaccttagggagtacgcaaatcattgcttcggataaaacgggaacccttacccaaaataaaatgacggttgaaaaactttttgtggataaccagctaatggatgccgcagcggtcacccctgattttcaatccaagttatttgacctgatgattttaaacaacgacacgaaaaaaattgacgaggagttggtgggggatcctaccgaaacggccttgattgcgtttaatgaccaacggggatactctagtgctgcggtaattgaccagtaccaacgggtcgctgaagtaccgtttgattcggaacgaaagctaatgtccacggtcaatgcgttaccggacgggaagtatttgattaccgttaagggagcaccagatgaacttttgaaacgaaccaccaagtacgtaatgccaggtgccgaattgccaatggacgaggctgaagagcgtcggattcaggccgtgaaccatgatttagcgttgcaagcaatccgagtgctgggctttgcgtaccggatcgttgatgcagttcctgaagagctgactagttcggtagtggaaaacgacttgatttttgcgggattagtggggatgattgacccggaacggcccgaagtggcacaagccattcaagaagcccacgacgcgggtattcaaaccctgatgattactggtgaccaccgcgatactgcgggagcaattgctaaacgactagggatgattaccgatgccgaagtggacacggcggtggtgactggtgcagaactcgatcagcaaactgatgaacaactagcggatcacgtagcaaattaccgagtttacgcccgggttgctcctgagcataaggtccggattgtcgatgcttggcaaaagaaggggaaagtggtggcgatgaccggggacggtgtaaatgacgccccctccttaaaacaagcggatattggagtggcaatgggaattaccggaaccgaagtttccaaaggtgctagtgacatggtattggctgacgacaactttgctaccatcgtggacgcggttgaagaaggacgtaaagtatttgccaacattcaaaaggcgattcagtacctcttatcagctaaccttggggaagttttaacccttttcgtgatgacgatgatgggctggcaaattttggcaccggtgcacatcctgtggataaacttggtgaccgacactttgcctgccattgccttgggacttgaacctgcagaaaaaaacgtgatgcaacagccaccacgtgataaaaaatctagcttcttatcgggaggcgtcgcgggtaacgtaatctaccagggaattttggaaggggccatcaccctatttgtttacgcaatggcgttagctttccctgaccattccgggagcgcacagattcatgccgatgcgttaaccatggcctttgcaacgttaggtttaatccagcttttccacgcctttaattcgaagtcgattcacggatcaattttccaagcaaccacttggaaaaataaattctttaattgggtgatcctcatcgcgtttgctttgttagcaattacgattgtggtgccgggctttaacgaccttttccacgttagccacctaaacttacaccagtggttaatcgtaattggagcatctttatcgatgattgtaatcgtagaagtggtaaaattaattcaacgaactttaaagaaatcacgaggaaattaagatgaaggtaagtattcaagcgtacgcgaacaccatttcaagattgactgagaaattagaagaaattggttctagcgtggatccgttttttcaagaattaaagaaggcgggtcaattaggtacggtggacgaaatggatcaaagccggttaaaagaaattaaaaaacaatttcaagtggcaaccgaccagtactgggcgctagaaaagatggtctggaatgctaaggtgccagctaaattaattggtaaacatcagttattgaaacgttacctaagggaatatgctaatcaatgccaaaaaatggttgatgcagtagatgaccaaaccaaaaagctggatgaggtagcctttcaagagtccgaacatgcccaggaagctgcaatgggccaaatgaccaaagcgttgactaaaattatgagcagtttgatgggatagatcattacttctcacgctgaccatttagttagtggaatcggagaggtttaaaaggaggctgggaaaaatttcctagcctcttatcttgtacaaaaagttttaacaaagtggggtttaaatttggaagcagagattttagctttagtggaaaaacaattgaccgcttaccgaccgcaacaaattcgcgcgacgttggagatgctcgatgagggaaatacggtgccgttcattgcacgctatcgtaaggaacgcacccacagtcttgacgaagtacaaattcgcgaaatccaggcggcgtaccaccaaacggaaacgttagaaaagcggaagacagaagttttaaagcagattgaagaacaaggcaaattaactactggattaaaacagcaaatcaagcaggcaaccaccttaactgcggtggaagatttatatttgccgtacaagcaaaagcggcgcacaaaagcgacgattgccaaagaagcgggactagaaccgttagcggcgtgggttttaactttcccccaacaaggactacgagaacgcttggcggctgccgttaatcccgaagcgaagttaaatactatcgaagacgtagagtccggggttcacgagattttggccgaagcctttggcgaacaggcggaaatccgggcgtggattcgtaaatacacccagcataatggcgcgctagttagcgaagttaaacggcagggcaaggaactagatgaaaacggcgtttacgcgatttactatgatttccaagcgccacttgctcagttagcagctcaccaagtgttggcaattaaccggggagaaaaggaaaaggtcctccggactaaggttgcggtggaagaagcgggcattgagcgctatttaaactttcgtttggtacaaaagcatcgggggccggcggtggcgctggtacaagcagcctatcgggacgcctataaacggtttattgggccagcaattgaacgagaaatgcgtgcggaattgacttccatggcggagcaacgcgcaattaaagtttttggagaaaatttataccatttgctgatgcaagcaccgctcaagggcaaagtggtcctcggttttgaccctgcttaccgtaccggttgtaaactagccgtaattgatgaaaacgggaagttcttagataaactggtgatttatccgcaccgtccggctcctcaagcaaagcgagccgcggctgctaagcaattaaaggacttcattgaaaaataccatgtggaaatgattgcgattggaaacgggaccgctagccgggaatccgaagaatttgtggctcaagtcatcaaaacaattgcgcgaccagtttactacgtgatcgtcaacgaggccggagcttccgtatactcagctagtccggctgctcgggcagcgtttcctgatttacaagtggaagagcgtagcgcaattagcattggccggcgtttacaagatccgttagcagagttgatcaaaatcgatccccaagcggtgggagtcggccaataccaacacgacgttgcccaaaaagatttgcgggaacagttggaccacgtggtggaaaccgcggttaaccaggtgggggtcaatttaaataccgccagtccagagctactgacccacatttcggggctaactaaaacgacggcgcaaaacatcgttaagtttcgggaagccaacggaagctaccgaactcgccaagcaattaaatcagtgccgcgactagggcctaaagcatacgaacagtcgattggatttttacgaattgtggatggagacgatgagcttgataatacgggaattcatccagaaagttacccggtggttaaagccctaatgaaggagctgggattaaacctgcatgacttaggaacccctgcttttaaccaaacgttgcaacaggttaaggtcgcacaattggcagctcagctacaggtcggagaagaaacgcttcacgacattctcgaagaattgcaaaaaccggggcgggatttgcgggatgaaatgcctgcaccattattacgctccgacgtcttaactttagaggacctccaaccagggatgcaactgcaatgcaccgtccgaaacgtcatcgattttggcgcgtttgtcgatatcggcgttaaacaagacggtttggtacacatttctaagctaaaaaaaggctttgtcaagcatcctagtgacgtagtggcggtgggggacatcgttaccgtttgggtggaaagcgtggataccaagcgaaatcggatccagctcaccatgattccggctgaggaacaatgactgacttagagctaactcagttaacgcgtcgactggctaaacaattctttaaccaaacttatccttacgaagcgcggtttaaccgtcgcttaagaacgacgggcggtcgctattttttaggggaccatcacattgaaatcaacccgcttatgctaagcgagtttgatgaagaaaccttagtaggcgtaattaaacacgaactagtccactactggttgcacgtgcatcatgaaaaaccagatcaccgcaacccgcattttaaggagttgctgcagcggaccggtggtttacgctacgcaccggtgacgtctaagcgccggactactacatcggggcgattagtataccagtgtaaaaaatgtggtcagctttaccatcgtcaacgccgcatcaacgtgcgacgctacgtttgtgggcgttgcgggggccggttaaggttaaaacactaataaaaatatttttataaaaaacacttgctagctaatggtggttttgctattattatctagtaaggttttttgcggccatggcggaattggcagacgcgcaggattaaggatcctgtccgaatttactcgggtggaggttcgaaccctcttggccgcattactcttcggttaaagagctgtgattcaacttaacttggatcacagctctttttttgtcaaaaaatgaccagatttccggggagttaataatacacttgatacactaagtgatacagaatagtgtattaaaatagtgtattattaaaaaggcttgtattcgcttacgttaagcctagtgtattttggcacggtatttgcttatatagttaatggaagctaaacatactgtgttagcggtatgttggtcctactgattaccattcggtggcggtagatcgacagctggccacaattttattgcaaatttaattttttctgagacgttgtgaaaacgtttttgggattggttaattaattttaaaattggaaaggctgtcaagaatttattctaactagttgcaggtttagaacttatttttattttttttcaactgtaacaaacaaaaaatgggaggtatacagacagatggtaggaattatcattgctagtcatggtgaattcgccaaaggcattttacaatccggttcaatgatcttcggtgaacaagaagacgttaaggccgtaaccttaatgcctagcgaaggccctgacgatctcagagcaaaacttcaagaagcaattgcttcttttagtaaccaagaccaagtattattcttagtcgacctatggggaggcactccattcaaccaagttaacaacttgtttgaagaacacaaggacaaatgggcaatcgttgccggtttgaacttgccaatgttaattgaagcatacgcttctcgtctatcaatggaatcagcgcaagaaattgctgcacacatcattgatacagcaaaagaaggggttaaggttcgtcctgaagaactccaacctaaggaagctccaaaggctgctaaggctgctgcaccagttaatactggtaagccaggccattttgattacgtgttagcacgaatcgatactcgtttacttcatggtcaagttgctacttcatggacgaagactactaacccggatcggatcatcgttgtttctgataacgttgctaaagacaagttacgttcatcaatgattaaacaagctgctccagcaggcgttaaagcccacgttgttccaatcgaacaaatgattaagttggctaaggacgacaaacacttcggtggtacccgggcaatgcttttgtttgaaacccctcaagatgctttgaaagccatcgaaggcggtgttccaattaagactttgaacgttggttcgatggctcattcagctggaaaagttcaaccaaataccgtattggcgtttgaccaaaatgatattgacacttacaagaagctggaagacatgggcgttgaaatggacgttcggaaggttccttccgattcacgggataacctcgacgcaattatgaagaaggctcaagatgagcttaataaacaaaaaaataactaataaaacggaggattaataatcatggcattgaatgcaatttaaatgattttagtcgttatcgtgtcattcttagctggtatggaaggtattttggaccaattccatttccatcaaccagtaattgcatgtacgttaatcggcttagtaactggtaatttagtaccttgccttattttaggtggttcactacaaatgatcgctttaggttggtctaacgttggggctgcggttgctcctgacgctgctttagcttctgtagcttctgctattattttagttttaggtggtcaaggtaaagcaggtgtttcatcagcgattgcccttgcaattccgctagctgtagctggtcttttgcttaccatcattgctcgtacattggcaaccttgattgttcacatcatggacgcggctgctaaagaaggtagctttgctaaattggaaatgtggcactacattgcgatcatcatgcaaggtttgcggattgcgatccctgcagcattgatcttggcaatcggtgctggtcctgtacgtggtttactttctgctatgccagcttggttgactgatggtctatcaatcggtggtggaatggttgttgccgtaggttacgcaatggttatcaacatgatggctactaaagaagtttggccattcttcgcacttggctttgttttagcaactgttcaagatttaacattgatcgctttaggtacaatcggtatctcacttgcgttgatttacttaaccctttctaagatgggtggttcaaacaacggtggtaattcaggtactggtgacccactcggcgacattatcgacaaatactagaaggaggccaacataaaatgcaagaaaaagttcaattaactaaaaaagatcgtattcacgtttggttacgttccacattcctgcaaggttcatggaactacgaacggatgcaaaatggtggttgggcatacacattgatcccagccctcaagaagttatacaagactaaagaagaccgtgccgcagctttgactcgtcacttggaattctttaacactcacccatatttagctgctccaatccttggggttacaatgtcacttgaagaagaacgtgctaatggtgcaccaattgatgacgttgctatccaaggtgttaaagttggtatgatgggacccctcgctggggttggtgacccggtattctggttcaccgttaagccaattttaggtgctttggctgcttcactagcaatgggtggcagtatcttaggaccaatcctttacttcgtattgtggaacgcaattcggatgggcttcacttggtatactcaagaattcggctacaaagctggttcaaagattactgaagatatgtctggtggtttactccaagacgttactaagggtgcttcaatcctcggtatgtttatcttaggttcattgattaaccgttgggttgtggttaagttcacaccggttgtttcaactgtaaaacaaagtaagggtgcttacattgactgggcaaacttgccaagtggtgcaaagggtatccaaaaggcccttatcgaacaatcgaatggtttgtcactcactcgtgaaaaggttactactttgcaagataacttggatcaattaattccaggtttagcaggattactgcttacattactttgcatgtggttgcttaagaagggtgtttcaccaatcatcgttatctttggtctattcattcttggtgttgtacttcacttactacacgttatgtaatgcaatgattccaataaagtctgggcaatggcctgggctttttttgttaagagtttttgcggttaactcgaccgcgcattataatggaaacagcaaatataaagaatggagcaaattgaatggtacaatcgattaacaccaaggtcgaccaggttacggacgcaacctcatttcttgggatgggggattacggcaaaataatgattggcgaccgcggttttgaattttttgataaccgcaacgtaaaaaactacattcaaattccgtggaaggaagttgacaaggtaattgcgtcgttaatgtttgggggaagatggattccccggtttgcaattaaaacgaagcatagcggaactttcagctttgcggcaaggcatccccacgaattgttgagaggaattcgtaagtacgtggatgaagaaagaatggtccgctcgctaggagtggtagacgtagtaaagcgcggattaaaagaagtgtggcgaaggatccgaaaatagagagcggaagccccttgggcagcttgtgaggattaacggaatataaggactaaccgcgggttgggcggttggtccttatatttggttaaccggaagaagctaggggctggagctcattttgacatggtagcagtaggacagcctccagaaccactgcactaaagcagaataaccaagttaaggcactgcccgttttgctgacggttggtgccttaattagttattcgggaattcaaacccgtgtgccctaggtaatccgccttgaaaacgctttggcgaaagtgtgataaactgtagtgtatcaatacagacagtgttttaatacagttaacgtggtgaggctaaatgaaacgacaagaaagaatatatcaatacgttttagaacatacggagccagcttcggcggacgaagccaaccggcaaaatggcttaacaacttcaacgattgcggacgcgttaaaaattgcgcgtagcaacgttagtaaagaattaaatgatttggttcggcaacgaaaattgtttaaaatttctggccgcccagtccgttattgtcaactagccctaaatgaagatgatccgttggcgcaggacccttcagagtaccatattgaagatgggattagcggtatggaactggggaaaaagaagctggcagggaagctcgataagccgacagctgctaaacagcttagtgtgcataaagatatctttgatcgaatgattggtaaggatcaaagtatgaaaaaccaaattgaacaggccaaggcggccatgttgtatccgccacgcgggttaaatacgttgattatcggaccaacggggtcagggaaaacgtactttgccaacgcaatgtttgattttgcacaggcccgcaacctactcagtaaggatcaacaattggtaacctttaactgtgcggattacgcccataacccagaattgctgatgtcccatttgtttggttacgtgaagggggcctttactggcgcagacgacgaacaagacgggttaattcaagaagcggatggtggaatgctgttccttgacgaagttcatcgccttcccccagaagggcaggaaatgattttttacttcatggatcacgggacctacagtcggttaggagaaactgctaagacccaccatgccaacgttcgactagtgtgtgcgacaaccgaagatcccgaaagtaccttgttgcaaacctttgtacggcggattccaattacgatccagcttccgccattcaataaacggagcccggaggaacgaattgaactattgcgttcgttagttacgattgaggccaaccggacgaacaaggaaatcactttaaccgaagacgtggttcaagctttgcttggtagcgttacttacggaaacgtcggtcagttgaagtccaacatccagctggtgtgtgcgaaagggttccttaataacattggtaacgaaggaaaaatcatgattacttccgatgatttgcctagcaatatcaaggacgggttgttaaacttggcgtctaaccggcaggaactcggagcgatttccaaacttttggaaccgtatatggtggttaaacccggagctagttacgccaccccggttacccgcaaagatagttacgaattgccctacaatttgtacgaaatcattggggataaagcgatgatgcttcgcgaagaggggctcgaccaagaaaatatcaataatttcatcactaccgacattaatcttcatttaaaatcattttataaaaacgatctggatacggtgaacgcggaaagtaagctagcggaaatcgtggacaagggaattattaactttaccaagcaaattcagcccaaggtggaaaatcggcttaactaccggttcaaggacaactttatttacgcgatgagtttgcacattagttccttcatcaaacgaatccaatcgggaaagccgatgcggttaatgggcaacgacttagtggcaatggttaaggattatccagaagagctcgaagtcgctaaatcaatcaaagagtcgctagaacaacgttacgggttgccaatcccagaatcggaaagctactacctggccgtgctcctaatttcacttaaaacggtgcccactagtaccggtaaggttggaatcgtggtggccgcgcacggtagtaacacggctagttcaatggcacaagtggtatcacaattgttgtcggataattcgatccaagcctttgacatgccattagatatgaatccgcaggtagcttataagggaattgtcgaccgggttcgcgcggcagatcagggggaaggggtgctactccttgtagatatgggctctctaagcacttttggtcctaaaattaccgaagaaactcaaattccggtcaaggtgattgacatggtaaccaccgcgatggttttggaagctacccgaaaggcgtccttcattgatagtaatttagacgaaatttacgccgaacttcgcgaatttcacggctactcccgggtggcaattactgacgaaggccagtctatggaagacgaccaggcggtagcaatgctttcgggaaaaccaaaggcggtaattgcggtttgttcaacgggtgagggcaccgcccaaaaaattaagggaattcttgaccagttgctattgcaaaatttaattgaagatattaaggtgttcccaatttcaatcgtaaacatgcaccaagcaattgaggaaattaaccaaaaatacaccatcgttgccacaaccggggtaatggatccggaagtgggagttcccttcatgcctttacaatccttattgcaggggggcggcgaaaagttcgttcgtcaactggcagaacgaagcgagctttcctgggtctttgatgaaaaggacgctaaactgacccggagcgtttgtcgacaatacttgtcgaagtactttgtgtttttgaatgctgacaaatttgccgatattctatggaattacgttgattaccttgcgcaaagccggcaggtcgaatttagcgagtccttccggattaatttgataatgcacgtagcgggcgcggtagaacgtcaactaacgaataatcccatgcaagtcaacgcagctgaacttgcggaagttcaagaacagccttggtttaaggcggttcaggaagctgatgaccaattccttcaacggattcaaattaaaatgaccctaggtgaagaattttatatttacaaattgttagaaacctggcaggaaaaaaatgatacaatcctaaatgagatggagaagaatcaatagtttttggaggaaattagaatatgacaatggaaatattgctcgcacgggtagacagtcggcttttgcatgggcaagttgccaccgcgtgggctaagaaagtgaagcctaaccggattttggtggtttctgacagtgtggcagaagatacattgcgtaaaacactgattacccaggctgctcctccgggagtgtttgtgaacgtgattacggtcgacaagatgatcaaaatttatcacgatccccaatttgattcgtttaaagtgttgctgctaacggaaacaattcaagacatgttgaaattagtcgagggcggcattgacatcagtaatttaggagttgacgtgggtagccttgcctacgcggtagacatgaccatgttgacggatgctatcgcagtcggtaaggaagaggtcgcggcgattagagcattggccgcccacgggttaacggtgtacgcccaaaaaattccgaacgatagccgcaaagatttgattaaaatgttggataaaaatggtttgtaaattggaaatgaattatggctaaaaaagagcgtgggacaaaagtttctaaataaaaaaacggttcatgaggcgaaatttcctcatgaatcgtttttattttggcgttttgacttcaatagcgccaaaacgtgtgccaaaagttagtttgtcccgcgcttcttttattgcatggtggataaccattagcaagccgcagagattacagctcttcgagaacttggttatccttaatttgtggttctggcttagtttgccgattttttatttcttgggcaatctgtaaaagaacgtccttttgaaaagcgactgcatccagattgacggttccctgggtggtggtaagcactaaacgcgccttgaaacctgccccgccaaggatgatgccgatgatgattgccaaaattcccaaggcaactccgtcgttcatcgtacttaaaatccctaacacaattaaaacgatccctagtagcaaggggaagatttggtttttgcttttgacctcggtagccttaatatcggctaggttaacgtctttagcaaccatcccatatggaaaaatccaaattaataaccgcgggatccggctccgcacggattgattatcgacttccacgcggcccttcatccaaaagattaaccaactaattgaaaaattaaacattcagcatacctccattaaaatatggtgcttgttaactttaaggataaatattaatccaacaaaaggcaagtagtcgatttcttaagagaaaaataagaattaacctttaagaagcttttggcgaataaatcgattaaagtggttagatggactagtgagatggttttcacaaccaatcgtttactgataaaataaaatgataaataaaagtaaggaagagttggcgaaatgagtttagaaattttagcaaccgcccattacgttccaaaacgggtggtggataatgatgaattagcacaaattatggatacgagcgacgaatggattcaatctcatacgggtattaaaactcgccactatgcgttaggtgccgagaacacgtcggacctagcggcgaaggtgggccgacagctgttgaaaaaaagtggtttagcggcggatcaaattgatttaatcattttatcaacgattacgccggactccttaactccggcgaccgcagctttagtacaggataaaatcggtgcccataatgcctttgcttttgacatttcagccgcttgtgcgggatttgtgtttgggctaagcaccgccgagaagtttcttcgggctgggcgttaccaaaatgccatggtgattagtgcggaaactaactccaagatgatggacttccaagatcgtacctcggccgtcttttttggtgacggagccggaggagctatcttaagtcaatcgacgaaggccgacgacttttttgtggatgaagaattggctacgttagctgaaaaaaatgagtacattcacagtggacggattccggctattaccgatgtaaaagcaagtaattatccgcaaatcgacgcattttaccaaagcgggcgggacgtgtttagttttgcgacgggggcggttcctccgcaaatgcaaacaattttgcaacgtaacgacctgcatgacaccatcgattacgtaatttgtcaccaggctaatttacgaattattgaaaaaattgcggaagaaacgcaaattccgtttgaaaaatttgttaccaacgtccaagattacggcaacacgtcttctgccggaattccgatggcgctggatcagttgcaaagtcgggatcccagtgctaaaacagtcttgttgactggttttggcgccggtttagattatggtagtttaattattaaattgtaggtagaaaaaatgaaaattgacaaagtctatgatattttaaatcgcctaaaagattatccgtaccaagaaatcagcattgaaatggaaggcttaaagctacacgtcaaaaaggcggattccgctccgacagctcccccaactccggcgcaagttacggatccgcaaccagcggggatggtagtgaaaagtcccatggtgggcattgtgcactttaaccaggaccttaccccgggacaactggtggaaaagggtcaggtgatcgcacaaattgaaagtatgaaattatttaacgacatcaaggccccccaagcggggacggtacaacgacttttagtggaagatggcgaaggagttgcttacgaccaacccctcgtggaattggtggggaaataaaatgtttaaaaaggttttggttgctaaccgcggcgaaattgccgtccgaattattgcagcttgtcgccagctagcaatttcaacggtcgtggtgtattcaaccgctgatgaacaggcccaattcgttcaaatggccgacgaagcaatttgcgtggggccggcgagtgcacaggaatcctacttgaatcgagaagcaattttaatggcggcccagatcaccggtagtgatgcaattcatccggggtatggttttttatcggaagatccgctatttgcgaccatggttgccgagtgtgggttgacctggattgggcccagtcccgaccaaattcaacgctacgcggataaagaacgttctcgtgaactagcgcaaaaacgaggggtgcccaccatccctggtagcgggctgattactgacgaccgacaaattaaacccgcagctgaagagctaggcttccccgttttattaaaggctagttttgggggcggaggcaaagggatccgggttgcccacgatgaacaggaattatcccaaatcattgcggtagttcgccaagaatctggtgcgtcctttggaagttcaccattgtatctggaacgggacctccaaaatgctcgccatattgaagttcaggtgctggggcttaacgaacaaatcattattttaggcgaccggaattgtagtattcagttgcaccgccaaaaagtagtggaagaaagtcctgctaacttgacgattgaacaacgcgagcggctgtatcaagcggttcaccgtttgttggatcaaagtggctatgaaagcttgggcaccgtggaatttttgcaagtgggggaagaattttattttttggaaatgaacacccgcttacaggttgaacacggggtgaccgaagaaacaaccggaattgacattgtgcagacccaaattgtagtagcggccggtcaaccagagctggtaaaggtgggggacgcccaagttcacgcaattgaggcgcggattaatgccaccgctccagggcaacttgttgaattggaatggcccgctactcgaattgaaactgggtatgctgcgggcaaccaaattgcaccgtattacgatgcgttggtaggcaaaattattgttacggcttctacacgagcacaagcagtacaaaaattacgacaagctttaaaacaaactaaaattaccggagtgccaacgaacttggccgcggtagagcaattagtcgcaagtcccgcgtttattcaaggaacttatgacattcgaacttatcaaaatcttttggatgggtgttagtgatgcaaaagcaaaatcgttggtcaaaatgcccaaaatgtggcaaacacgtacatgaattacaatggggaacgtttcggcgttgccctttttgtcgttgtccacaacgtttaacggtggaagaacgaattgcgattacttttgacgaaggtaagtttaaccagcttaccgtgccggtggaaacgcaaaatcaattaaattttcccaattacgaccaaaagttagccaagagtaggcaacaaagcggacacggcgaagcagtcaccattggctgggggaccatcgcgggaaatccggtagctgcgggaattatggataaccggtttatgatgggaactttgagcacggtaactgggattgcgttgcggcaaattatgcgttgggcgcggcaccaaggttacccgttgattttgtttacggcttcgggtggcgcgcggatgcaagaaggaatttatgcgctgcttcaaatgaatacgattttagctgaacaacgccggttgcgggaagctggcggattaagcattaacgtgttgaccgacccgacgatgggcggggtgtcagctagttttgccttcaaaagtgattacgtaattgcggaagatcatgcgcagattggcttttcaggaaaacgggtaattcagcaagccactggagaagacttgcccgctggttttcaaacggccgaatacttattgcagcatgggcaattagattccgtagtgcagcgagaagagttgcgcggttacttgcaacggttactaagattacatgggtaaggtggttaacatggataaggaattaagcgcgcggttaaataaggttcgttccgcgcaacggattacgggccagcaaattattcaacggctatttacggaaattgtggaaatgcatggtgaccgggtgaatagcgatgatccggcggtatgggcgggaatcggcctttttgaagaacaaccggtgacttttttaagcgtggatcgggggcaggaccttaccgagcggttagcgaaaaatggtggcgcagtccgggcgggcggttatcgcaaggcgttacggaacgtggagttagcccaacggtttgaccgccccgtggtcagtttcctaaacatgccgggcgccgatgctagtgttgactccgaaaatgaaggtcaaagcttaatgattgcccacctgatggaaaccatgggtgcgctccgggttcctaacttagcggtcatcgttggcgaaggccatagtggaggagcgctagcctttgccaacgctaaccaattatggatgttagaaaacggtctgttttccgtcgcggctccggaggccatggcggcaatattacgtgatgaccgtgcattggctcgcgtgcccatgactgctagccagttacaacaaattggaattgcggaccaagttttcaaggaagatccccaattaactgaaaatttaaggaaagctttgcggcaatggcttgcaacgagccggaaaatggatgaaaatgaattagtgatgcaacgtgagcaaaaatttcagcaagttttacgggattggtttgccgattaattgctgaaataggggagaaagtaatggctaaattagttttgattcgacatggtgaaagtacggctaaccgggataacgtttatacgggatggtctgacgtcccgctgacggaacgcggcatccaacaggcccatgaagcgggaaaattgttggcaaaggcgggaattaattttaccgcggtgcacacctcgatgttgcaacgggcaatcgtcacggccaatattgtggttgacgaacttggccaaagttggttaccaattaccaaaacgtggcggttaaacgagcgacattacggtgcgctgcgaggacagaataaggacgtgacccgccaaatttatggtaaacatcaggtagccttgtggcggcgaagttttgatgcggttcctcctttactaaaccaggccgaccacgaccgtcgctatcggatgtacgggatccttcacgaaccgttaggagaaagtttgcatatggcgtacgaccggttactgccttactgggttgaccagattgcgccacggctgattcaaggagaaaatcagttggtggttgcccacggcagttctttacgagccctaatcaagtatcttgaacagatttcggatcaggggattgacggggtcgaagtggaaaatggcgagccgatcgtttgtgaaatggatcaccatttaaacattgtgcaaaagactaaaatgtaaattttaatgctaaaaagagagtgggacaaaagtcgggtagtttgcgagcattaactgaaaattgactgatgcctgattttggcatgatggtcaatttttggttaagcggaaccaactgacttttggcacccgttttggcgctattgaaggcaaaacgccaaaataaaaacgattcatgaggaaatttcacctcatgaaccgtttttttgtttaaagacttttgtcacagcgcctttttagatggtggtagagcggcgttttcctgcaacgtaatcgaaatgagctccagccaccaagtttttccggttaaccaaatttagggtttaatcgcctaacccgcaattaaatcctaaattctgttagttctcataagctacccaggggctttgttctctaatccttgtacgccaacgatcccatcggatcccatggcttcaacaccgttgggtcttctgcttgggccttacgttgggcttccgttaagtattgtttttcaacaacaacttggtagcagtattcgtccatccacgcgtctgacattaccaagtagcccttttcgccgactttctttccccaactattttcgactttccacttcgttggttgaccatcgacgaggtcgaccccggttaataccattgcgtgggtcatcaaactttccttgtaatctaggcgttcagccttggtcatggaaaggtcaatatcaaatagttcatcttccgcaaaggcgtcaaggtcgagcagtcctttttcacgagcttccgaatgttggttaacgtcgcaaccaaaccaaactgatttaccagcttttaattggttaatcgctgcttgcttgaagtccttcatggtaaggttcaagtgtttaacaggccgaccattgaccacgttacctaacatttcaattgtgtacgtcttgttaaatggcttatccgcagttggtgcattaatgattgaaacgtagtcatcaaggttccaacccacgtatttgtcataaaattctttaggagtaattccagcttcccgatggtaaacttggtcgctatcccggaattcccaatcaaatttaactggcggttcaccaaagctgtaagcagccatccggtaaacttcgctaagcattttttccttccgactttggatttcatcttcactagcttggtcccggaccatcttacggagggtgatcgcatctttacgaagtttttcgtttaatagggtgtcgaattcacgagatttagaactattgtacgtttctgggtaaacggattgtggtaccacgccatatttttcaattagggcgcacaacatatcccattggccaccgtcaccttggggctcgttaagtaggaaggccacttcgcggtcgtctggttcaagatcggcggttttaatgatgttttcgtagaaccagtttgatttttcaaacttatcccagaagaaggtgtaattttgggaaagttcgaagtttcctggcaccttaaactgatttttcatgtcatgacgcatggtgtttaaagcggcaaacatccagcagcgcccgctttgtttttggttggccacgtcaccggtgtccaaatcaatggagaaaaccggagtactttgaatatcggcagctaagttacgactggcgttcaagattccattcttcgtaaccgtccgttccagtaccttggcttctttgcggtcgtgatattcttgattaaattggttaatcaattcgttagaaatttctttactcaaataaatcagctccaattctttttaaaaaactttgcttattaataattaaggacgtgcttgaagaacttcgggtccatcttggcggccgacgattaccgtgttaaccgtgtctaaaaagaggccttgttcgacaattccaacctgtttgattaggtaatctgccaatgcatgcgggtcgtcaatttcatgtaaatgcaagtcgattacgtaatttttagagtcggttaaaacgtgattaccgttttcatccatgcggaactcagggttgaatcccttggcttctaatttcttgaagacttgcttgctaccataaggaattacttcaagcgggagtgggaaagcgcccaacttgtcgaccattttagattcatcaacaatccacatgttcttgctggaattggtcgccacaattttttcgaagaggtgggctgctccgccacccttaatgccttggaaatcgctactgatttcgtcggcaccgtcaatggtcaagtcgatgtggtcaacctcgtcaaccgacttaacggtaattcctaaatcgcgagcttgtttagcagtgcggtcggaagtcggaacccccacgatgtttaaattttcttccttgacgcgcttacccaaggcgtcaaccataaatttaaccgttgagccagttcctaagccaacggtcatgccgtcttcaataaatttaacggcttcgttacctaccagtttttttagttcattttgatccataattatctactcactttcggttggttagatttttaactttttcagcagtgatttgttcgtgcatattcatgccggcaagttcgggatggttttgaaagtacttgagggcaaacgggcaaagcggataaatcttttgttcccgttccttagcaaattccacaaaatcagccatgattttgccaccgattccgcggccgcgaaactggggattcaccagaacttcttcacagatcaaggttgcatgatccggcattggggaatataaaatttgtccgacctggtcgttagcgtcgtttatccaaaataggcgattttcatcaaggttacgcttcattttccaagcctccttaccctattaattgtcgtaaagaaagcggataaagtcaattgattaccgagatttacgtttacaaatttttggatacaacggataatgaaataaacatcattgggaggaacgatatgaaacgaggatttgagattgtaagcagttacgaaggacaaggattgcatttgccacaacggcagactaaggcagccgcggggtatgattttgaagcagcccgtgattttacgttgccaagtatttggaagatggacttcattaaagttttgtgggcagttcgccaccaagaagaagtttctcccgcgcagcaacaattggcccaagcggctttaaaaccttacttagtgccaacgggaattaaggcttacatggcagatgatgaatatttaatgttagctaaccgttccagcaacccgctaaaacgaggattaattttacctaatggggtgggaattgttgacgctgattactacaataattccggtaatgaaggagaaattttcttccaattaattaactatggaattacggacatcaccattaagaagggtgaacggattggtcaaggaattttcatgaactacctgactgcggatggtgaaacgggtaacctccaaacgcggacggggggctttggttcaaccaaacgataattaaaaatcaataaaggtcaaacaaatcactaataaatctaggtgatccatgctattctataaggtgatcacacggattgagaggacgggagaatggcaaaagttaagacccagtttgtatgcaataattgcggatacgcctcccctaaatttttaggacgctgtcccaattgtggtaagtggaacactttagttgaagaacggatgagcgatccaaaggatgaacgaaaaagtcgggtgagctttgacggcaaacatacgcaaccacagctgatttcggacgtcgcgatgcacgaagaaccccgggtaaaaaccgggatggaagaacttaaccgcgtgcttggtggcggggtggttgacggctccctagtcttaattggtggggatcctggaatcggaaaatcaaccctgttgttacagctatcaggacagttggcagagacgcaacgcaaggtactttacgtttctggtgaagaaagtgcttcccagattaagatgcgtgccgaacgattgaaagtcaatagtgaacgcttctatttgtatccagagaccgatatgtctagcgtgcgggcggtgattgaggagttacaccccgaatacgtgatcattgattcggttcagaccatgcaggaaccggatattgaatcggcggtggggagcgtttctcaaattcgagaaattaccgcagaattaatgcaaatcgcgaaaaccaataacattaccatcttcatcgttggtcacgtgaccaagggcggcgcaattgcggggccgaagattttggaacacatggtggatacggtgctttactttgaaggtgatctgcaccacacttaccggatcctgcgagcggtgaagaaccggtttggttccacgaacgaattaggaatctttgagatgcgcgaagaagggttacgcgaggtggctaacccgtcagaaattttcttagaagagcggctaaaagatgcttcaggatcggcaattgtagtttcaatggaaggaactcggccgattttagttgaaatacaagccttgatcacgcccaccatcttcggcaatgcgcagcgcacggcgagcgggttggaccgcaaccgggtttcgctgatcatggcggtgctcgaaaaacgggcaaagcttactttgcaaaaccaagacgcctatttaaaggcggcgggtggcgttaagcttgacgaacccgcaattgacttagcgttggcgattagtattgtttcaagttttaaaaatcagggaacccggccgaccgatagttttgttggtgaaatcggcttaactggtgaaattcggcgagttaaccgaattgaacaacgggtcgctgaagcacaaaagcttggttttaagcggattttgattccgaagaataatttgaaggggtggcagccccccgaaggaattgaagttgtaggggtagctacgattgccgacgcgattcggcgggcatttaattaacggtgccggtaactagagcaagggcattaaaaagataattgattgtttgacgtacgagtgtagttggaaaggtaacttttcgacttgaatttatttaacacgagggggaaagagaatgaaagacatcaagaaacggatcgtccaagcggtcttcgctttggccggcggggcgctaggaatggcgtacctaccgttgatctggttgatcttcaagatcaacacgattgttttattaaataaccgggtgactaactttttaattggggcggttattttttggattctttccattttcttgacgagttacgtcttgaaaatgatgaaacgaatcgaaaaggcgttaattgatacgtcgccgctatatttaattaccggaagcattggaacggtattggggctagtaattgcaattttaatttcgaccttattctatcggtcccacgttttctttgtgaatacggtaattccgttgattttaatgttaatgttgggttatttgggttaccgattaggaacgacccggtttaacgagtggaagaagttgttccagacccggaagcgcgatggaaataaccaagtgcttgaccgccgggctggtgaaaattaccaccactacaaaattttggataccaacattttgattgatggccggatttacgatttggtgaagacgggattgctagaaggtaccctgctggttcctaacttcgtattgtatgaattacagtacattgccgattctgcagacagtattaaacgggtgcgcggccggcgcgggctggatttcttaaacaagttacagagcgaaaaaatcatgcccattgagatgtacgaaggcgattacgaagagattgaagaagtcgacagtaagctgattcagctggccaaggacaaggacgcggtaatcgttactaacgactacaacttaaacaaggtgagtcaattccaaaacgttcaggtactcaacattaatgaattggctaacgccttgaagccgcgggtaattccgggtgaatcaatgaacgttcacgtggttaagaatggtacggaacggcaacaaggggttgcttacctagatgatggaacaatggtcgtggtcgaagacgggaagttctacattggaaagacgatcgaagttatcgttacgagtgcaattcaaactgatgcgggacggatgattttcgctaagccgatgcattccacgaaggaaatcacccacgataagccagacgaaaaggaaggcaaaaagccagaatctaagtaaagaattgttcaggcttaaagattcaggagtccggaagaaaagtttttccgtggctcactttatttctgtagtagataaatgtagaatagagacattgtgacataattttgggagaggtgttaattttggcaaagcaagaaatacgcgtgcggtatgcgccaagtccaacgggacatttgcatatcggaaacgcccggacagctttatttaattatttatttgctcgtcactacaagggaaagtttatcttaagaattgaagataccgaccaaagtcggaatatcgccgatggtgaacaaagccaaatcgataacttgaagtggttaggcatggattgggatgaaggtcccgacaaacccggcgattacggtccttaccggcaatctgaacgaaaagagatttaccaacccctgatcgaccagttggtagcggaaggcaaagcttacgagtcatacatgacggaagaagagttagctgctcaacgcgaagaacaacgggcaaacggtgaaatgccgcattacgttgacgaatacgctggattatcacctgaagaaaaagcccaaaagattgctgacgcaaaagctgcgggaattcaacccgtaattcggtttaaggtacccgaacacaagaagtacgaatgggacgacattgttaaaggccacgttgcctttgattctgaaaccatcgggggcgactttgttatccaaaaacgggatggcatgccgacctataacttcgcggtagtagttgacgaccacatgatgaagatcagccacgttttccgtggggacgatcacgttgccaacacaccaaaacaattgatgatttacgaagctttgggctgggaagcaccaaaattcggtcacatgagcttgatcatcaatagtgagactggtaagaagctcagtaagcgggatgaaacaatccttcaatttattgaacaataccggagcttaggttacctaccagaagcaatgctaaacttcatcgtattactcggttggtctccagtgggcgaaagcgaaatctttacccaacgcgaattcatcaagatgtacgatgaaaaacggttaagcaagtctccagcggcgtttgacgcgaagaagttagaatggattaacaaccaatacgtgaaggctgctgatgaggatcgcattatgcattccgcattgcaccaattgatcaaggcgggcaagattgaaactgatcctgctccaatgaagattgaatgggctcgtaagttaattaacttgttcaagcggcaaatgagttacaccgcgcaaattgttgattttgctgaactattctttaacggtccggaagacattgacgaagaagctaaggcagaaatggctaaggacgatgctttaccagtgcttaaggctttggaaaagaagtttgctgacttagaagtctttgatacggtaaacatcttggcggctattaaggcggttcaaaaggaaaccggcgttaagggtcgtaaattgtggatgccgattcggattgcaattactcacgaaatgcacggaccagaattgccagaaagcttggaattattgggccacgaattatcgatgaagcatttgcgagcaatgattgaagaattaagctaaataaaaataattagttcatttaatgaatgattaaaaaggggctggaaaagtaatttcctgagggagaatgctttttgggcctcttttcttctttgcgttagcttttgttttcaattatcattaggagagataaaaatcccctgagggagtgaaaaaatgattaaactatataacacgatgactcgttcaaaggaagtttttaaacctttagttgatcagcaggtctccatgtacgtatgtggaccaaccgtgtacaactacattcacattggaaatgcccgcagcgtaattgcgtttgataccattcgccgttacctagaataccgcggttatcaagttcgatttgtgtctaactttaccgacgttgacgataaaatgattaaggcggcccaagccgaaaacatcacggttccggaactagcggaacgctacattgcggcttttaaggaagacgttcaggcattgaacgtggaaccagcaaccgtaaatccacgggcaactgaaaacattacggacatcactgcctttgtggcggacctcattgaaaaagactacgcctacgttgtggagggcaacgtgtattaccgggcccgtcggtttaaaaattacggcgcactttcccaccaaaatatcgatgagctagaacagggtgccagccaacacattaacgacgaagaaacggcgcaaaaagaagatccgatcgactttgcgttgtggaaggctgctaaacctggcgaaattgcttgggaagctccgtgggggaagggccgtcccggttggcatattgaatgctcggtcatgtcaactaagtatttaggcgacacctttgatatccacgggggcggcgaagatttacaattcccgcaccacgaaaatgaaattgctcaaagtgaagcccggaccggcgtgcaatttgcccggtactggatgcataacgggtttgtgaccgtgggcgacgataacgaaaagatgagtaagtccctcggcaactttgtcacggtgcacgacttaattaagcaagttaacccgcaagttttgcggttcttaatgtcgaccacccaatatcgcaagccaattcaatacactgaaaccagcctgcaagacgcgaaaaacaacttggaaaagttgcaaaacgcctacgttaatttaaattatcgcctccaaaccgctgatggagctgctgatccagcagttgatcaacaagccacagcgttgcaagctgactttgtgacggccatggacgacgattttaacgcccaaaacggaattacggtagtttacgaatttgcccgcttaattaacgtttatagcgaacaaacaacggtaaatcatgaacaaattgcccgcttagcaaaacaatttgcggaaatggcagcaattttcggtattgaattagcaaccgcaacggaagccccagctgacgaaaaaattgaagcgctcgttaagcagcgtgacgcagcccgggctgcgcgcgattttgaaactagcgaccgtttgcgggatcaattaaaagaaatggggattattctagaagatacccctcaaggaacgcgttggagaaaaaaagatgagtaaagagattaattatcaagcaattaacggaatcgcccttgcttatttaggggatgcggaatatgaagtttacattagaagacatttgattgaagagggcatgaccaaaccgaaccggttacaccacgtggcaacccgctacgtgtcagcaaaggcccaagcggcgttaattgacgcaatgcaagaaaatgattttctcacggaagcggaatgggaagcctttaataagggccgtaacgctaaaagccacacttcggctaaaaacacttccgttttaacgtatcggatttcgacaggatttgaagcaatcgttggttatttatccttaaccaaccaaactgaacgcctagacgaatttgcacagtggtgcattgataaagtagaggaaggaaaattacgtattgaataacgaaaacaaacaacaaccggacttcgtaatcggccggcatccggcgatggctagcttaaaaagcggtcattcgatcaataaggttttcattcaagaaggcttaaaatcggaaagtatcggccaaattattgcaaaggctaagaagcaggggctggtgattcaacgggtttctaaatctaaattggatacgctagctaacgggcaaaatcatcaaggagtagttttggcggtagcatcctttgaatatgcttccttagagcaagtttttgaattagcagagtctcgtaacgaagcgccgtttgtggtgattttagatggaatcgaagatccgcataacctcggttcgattttacggacggcagatgctaccggagttcatggggtaattatcccgaaacggcgggcggtaggtttgaccagcacggttgccaaaacttcggccggggccatcgaacgggtgcccgtagtgcaagttaataacttagtgaacactttgaaggaattaaaggatcgtggtttatggatctttggcactgatatggcaggcaccgactatcggcgttgggatgctactggcccagttggcttaatcatcggtaacgaaggtaagggaatggcgcgacttaccaaagaaaatgttgacgagatgttaaccattcctatggtgggtgacattcaaagtttaaacgcgagcgttgccgctggtttattgatttatcaaggatacagttcccgtcatccgttataaaactaattaacgaataattgactgaaaagtcggttattcgtttttttaatccaaaaaacccggttggttgttcaaaaaaggcttggtagcataactttccgtaaaagtaagcgattacaaaaaaggagaggttatagtgcaacaagttgatttagacgaagccaaaattattgcggaggtcaaggcagatgacacgcacaattttgaacgattgtttaacaagtaccacccgattatcaaaaagatgcgccaaaagtacaccatccgaagtttcgattgggatgattggatgcaagaaggtcggatcgtcttttttaactcggtggttaattacgatgcggatttaaaaattacgttaggagcttttttcaaaaataatttccgcaaccgcatttttagcattttacgttttgaaatggcatataaacgaaaggcgggctttgccgcgcagtcgttagaagagttggaagaagaagccgaggtcttgggacaacaggtttcccggattactccacagaaccagttgatggttaaagaaacgtatgcggagtatgaaacgttgttgtcgccatttgaaaaggaagtttcggtcttgctttttcaagggctacggccggatcagattgcagaacggctgggatacgacgttgctaaaattcaaaacgcgttacttaggtgtaaacaaaagttaagccgccaattatacgaataccgctaattgacattcagaaaagagcatgctaaagttgagtgacgataaggaggggttttatgtcccagaaaaagattgctttagcatgtacggtttgcggatcgcgaaattacacaattgttgcgaatccacaacgtacggaacgtttagaagttaaaaaatattgcaaacgttgcaataagcacacccttcacagtgaaaccagataggaggcgggacatatgtttcggtttttaaaaagcattggacaagaaatgaaggaaattgactggcctaattttcggcagttaagacatgattcggcaacggtagtttccacgtcattgttctttgtggccttcttggcactggtagactggttgattcaattattcttaaagttgtttatctaaatggctttatggggataattttgttataatttgattgttggtaaaaacttcgtgtctacggagtttttttattttggaaaaggagcgctaattttggaatctgaagaaaagaaatggtacgttttacatacttactctggttacgaaaataaagttaaaaataacttagattctcgggcaaagtccatgggaatggaagactacatttttcgggtagtcgtaccggaagaagaagagattgaaaccaagaacggtaaggaaaaaacggttaagaaaaacgaatttccgggctacgtattggtggaaatggtgatgactgatgattcctggtacgtggtccggaatacaccgggcgtaaccgggttcatcggttctcatggttccggaagtaagccaacgccgctgttacctgaagaagttgaccgggtgcttcgtcgtttaggaatgacggctcgtcacgcggatattaacgtagaagtcggcgaactagttaccatcgttgacggagcattcgaaggtttgactggtaaaattaccgaaatcgaccacaataacatgaaactgaaggttaacattgacatgtttggtcgggaaaccagcaccgaattagatatcgaccaaatcgacaaaattgattaatttctagtttgataatttttttggtctatggtaatatatcgtagtatgccttgcatacttaatgtgggagaagaaatataaatcttcatcgtgaccacacacggacttattttaaggaggtacgtctcgtggcaaagaaagtagcaaatattgttaaattgcaaattcctgcaggaaaagcaactccagctccaccagttggaccagctcttggacaagcaggtattaacatcatgggattcacaaaggactttaacgcacgtacagctgaccaagctggtatgttaattccagttgtgattaccgtttatgaagaccgttcattcgacttcattacaaagacaccacctgcttcagttctattaaagaaggctgctggtgtagaacatggttccggcgaacctaacacaaagaaagtagctaaggttacttctgcacaagttaaggaaatcgctgaaacaaaaatgcaagatctaaacgctgcagacgttgaagctgctatgcgcatgatcgaaggtacagctcgtagcatgggcttcgaagtcgaaggctaatacgaaactgtcggatactctactaaagtagatgtatcaaagtgggaggaaaatccgctataaccacatttgctaggaggaaaacacacagatggctaaaaaaggtaaaaagtttcaagaagctgcaaagcaagtagattcgcttaaagcatacgcaccaaaagaagctcttgaattagttaagaaaattgattttgcaaagttcgacgctactgttgaagtagtttacaagttgaacgttgacacaaagcaagctgaccaacaattacgtggtgccgttgttttaccaaacggtactggtaaagaacaaaccgtagttgtatttgctaagggtgctaaggctgacgcagctaaggcagctggtgcagacgtcgttggtgacgatgacttagttcaacgcatccaagacggttggttagactttgacgttgccattgcaactccagacatgatgggccaagtaggtcgtttaggacggatcttaggacctaagaacttaatgcctaaccctaagactggtacagttacaatggacgttgaaaaagcagttgctgattctaagtctggtaaggttacataccgtaccgaccgcgacggtaacgttcatatgccaattgggaaggtttcatttgaagctgaccaattacttggtaacttacaaacaatcaacgatacaattgttcgtttacgtccagcatctgttaagggtgcttacatccaaaacgtttcagttgcatcaacgtttggaccaggagttaaggttgactttactcaattctaaattctcttgattagttcttcggtctgtgatatattatcaagagtgaattataactgaataatttacctaagactcaggtggccttgctttggccttaatatattgcctgccgaggaacgtatgaattaattcgtgtctcagagtctttgagtcacggatttttttatagttcaaacaaatctccaggaggtgaaacacattgagtaaagaagctatcgcaaagaaagctgcaattgttgatgaagttgcagaagaaatgaagaacgctgtttccgcaatcgttgttgattcacgtggtttaacagttgctgaagtaactgacttacgtaaacaacttcgtgattctggaatcaagttccgcgtgatcaaaaacaagattttgactcgcgctgctgaacaagcaggttttgaaggtatggatgatattttcgttggtccttcagccgttgcattttctgctgaagatgccgttgcccctgctaaaattttgaagcaatttgctgacagcaacgacaacctttccatcaagggtggggttatcgaaggtaaagtggctgatattgatacaatcaataccttcgctacgatgcctagtcgtgaagacttgcttgcaatgcttgctaatgaattcatgtcaccagtacgtgacgttgcatacgctcttaaggctgttgctgataagaagtctgaagaagacgctgcataatcattacattacatttaattacaattaatattggaggaaacaaaaatggcattagataaagaccaatttattgaagacttaaaaggtgcttcaatttctgacttaaacgatcttgttaaagcaatcgaagacgaattcggtgtttcagctgctgctccagttgctgctgcaggtgctgctggcggtgctgcagaagctaagacatcattcaacgttgaacttactggcgctggctcagctaagatcaaggttatcaaggcagttcgtgaaatcacaggcgctggcttgaaggacgctaaggacatggttgataacgctcctacagttatcaaggaagacctttccgaagacgaagcaaacgacatgaaggctaagcttgaagaagctggtgctacagtagaagttaaataagtttaatttctacaaaaaccaccttatcccggttataccggaatataggtggtttttttgtgctttcataaacgggatatggtggatattaatgtggtacttttgtgggtacatggaaatctgtgtacccacctatgtactttaaaggacgtaagagcaattggagcattatataagtaaacttccaaacgtactgtggtaaagccttgttagcgatgttaaaagggaggttaggtagagagaaagacaatggattttatagaacaaaaacagcgcccaggatcttcatcctgagcgctgttaatttttggggattattcgaatgttagtaaattagttgattaaatttcgtagtcttcgtcactcattggttctacgttacctagacggtagccattaccaacttgagagaagaagtcgtggttagatgttccggtagaaattccgttcatgacgattgggttaacgtcagcttccgtatcggggaagagcgggtcttgacccaagttcattaacgctttgttagcattataacgggtgaaggttaacacttcttccgtccaaccaacttgatcgtaaactttatgaacgtatttttcttcgttagcgtaaaggtcgtataagaagttatacatccaatccttaagttcttgttgttcgttttcgccaaggtctttcattcctaattggaacttgtaaccaatgtaagttccgtgcacagattcgtcacgaaggattaatttaatgatttcagcaacgttgtttagcttgttatgccccaggtaatagagtggggtgaagaagccagagtagaataagaacgtttcgaggaacacgctggaaatcttctttttcaatgggtgaccatcatcatgatataagtcataaataaacttagttttgttttggaggaactcttcagagtcactccattcaaaaatttcatcaatttctgtaggagtattcaacgtttcaaagattgatgaataacttttagcatggacagattccatgaattgaatgttattcaaaacggccgtttcgtgcggtgtccgaacgtccttacgtaaggctgccattccgtcttgtgattgtaaggtatcgaggagagtcaagcccccaaaaacgtgtccaaccacccattgatggtcctcatcaagttcacgccaatcactaagatcgttagaaattggaattcgggtgtctaaccaaaattgttcggttagcttttcccaagttgctttatcaatctgatccgaaattgcgttccagttgattgcttcataatttgccattatacaaatcctccatcgttaaattgagcagctttcacattggttaacgccgacttcgccatcattatccgtgaaggtccgaatgtagtaaatcgacttgatcccttcgtggtgtgcgtaattgcgcaggatatttaaatcgcgagtcgtcattttgtttgttcgaccattcttccagtcgtaaatcccgtctggaatggttgagcgcatgaagaaggtcatgctcattccttgatccacgtgttgttgcgcagcggcgtaaatatcaacaactttgcgcatgtcaatatcataggccgactgataatattttaacgtatcattggacaaatatggggctggatagtaaatttttccaattttcttttcttgacgttcttcgacccggttaacgatcggctgtaaactagctgttgcgtcgttaatgtaagaaattgaaccggttggggcaaccgccattcgattttgatggtaaaggccatcttgcataacggcttgctttaggtctgcccagtctgcggtagtcggaatgtcgattccttggaagagttcctttacccgcgctgacttaggtccaaagtcttgagctaggtatttgtcgaagtatgaaccatccgcgtacttgctcttttcaaagttgtggaaaacttgtccgcgttctttagcaatcttgttggaagcctggagcgtccagtagttaagcaacatgaagtaaacactggtgaattcaacggaatcaggttcgccatagtagaggtggttctttgctaagtaaccgtgtaagcccattgcgccaagcccaatcgtgtgggcaagggcgtttccgtgttggattgacggcactacgtcaatatcggaatggtcggttacgaaggtcaacgcccgaaccatggtttctaccgatttaccaaagtgcggagttgccatcatattaacaatgtttgtggagcctaagttacaactaatgtcggttcctaactccgtgtagttttgtttgttgtcaattacggaaggagtttgaacctgcataatctctgaacagaggttactcattacgatcttaccgtaaattgggttttcccgattggctgtatccacgttcaccacgtaagggtagccagattcttgttggagcttcgaaatttcattttcgatattccgcgctttaactttgtatttcttgatttccgggttgttaactaagttgtcgtattccttcgtaatatctacgtaagcgtaaggtttaccataaactttttcaacgctgtaagggctgaataagtacatgtcttcgtcatgcttaatcaattcgtagaatttatcgggaactacgacacccaatgaaagggtcttaacccgaatcttttcgtcggcgttttccttcttagctgaaaggaaggaaacgatgtccggatggaaaacgtttaggtaaactacaccggctccttgccgttgaccaagttggttagcgtaagaaaaactgtcttcaagcaatttcattacgggaactacgccacttgcagcgccttcgattcccttaatcggtgcgccagcttcccgcaggttagtgaggttaattccgaccccgccgcctaatttggaaagttgcagggcagagttaatcgtccggccaatcgagttcatgtcgtcgttagcctgaattaaaaagcaagagactagttcaccacgatgttttctaccagcatttaaaaagctaggggtagctggttgataacgttggtgaataatttcgtcagcaatttgcattgctaactcttcgtcgccatcaccaaagtaaagggcgttcatggcaacgcggtcaacgaagttttctaagtaatattcgttatcgttagtctttaaagcgtattgggcatagaatttataagccgccatgaaagagcggaaatggaaattttgtgcacgcaaataatcgtaaagcttttcaatgaagtcaaaggaatatttttccataagttcggcttcaatgtagtcttccttaaggaggtagtcaaagcgttcacgcaggcttgcaaattgcttggtgttagcttgcacgttttcctttagaaaggctgcaagggcttcttgatccttatgtagcggaatttggttgtcaacggggatgttgatttcattgtttaagtcgtaataggtaacgtcggttagatcttttaagctcatatttgggtgtactccttaaatttcgaaataaaaaaacgctccatctgtaacaaaggaacgtggacactaaatcaacaaactaacaatttaaattaaatcgctaatttttttaacaagtctggacgaaaaccagcaattgcatcatcttcagaaaattgaactacgggaacggcttggaaaccgcggccttttaattcgtcaatatattctggatgtaagttgatgttgcgttcttcaaattcaactccgttttcacttagaaaacgcttggtcattttgcattgcatgcaattgtttttagtgtaaacaacgacttttttcatggtgactccccctcttatttattctttctgtctgcatttaagtatacaacatttcggaccgatttcaacaaaaaagcacatcatcttgtggctttaacgggtcaaaaccaccagatgttgtgctacgtcggcattcgccgagcaataaaaattattttaattaagttggtatccaaatttacaatacgttatcatactaatagagattggaggacttttcaatgacagattattatttcacggagaatcctaacgtggaacacgatgaaaagcattggcgttacacacttttggggcacgaattaaattttgtgtcggacaacggagttttttcaaagaacaccgttgactttggtacccggacattattagaagctttgccactggatgttccccaaagttcaattttagacgtgggctgcggatatggtccaatgggaattgcgctagctaagcaattccctgaagcacgagtggagatgaccgacgttaacgagcgggcgttagcacttgccgagcggaatgcagaagccaatggcgtagctgcacgtacacgagtttaccattcggatgcttacgaagcggtagctaaaactgattttacaacggtcgtttctaatccgccggttcgggccggaaaaacggtggtaaacgccatcattaccggtgctaaggagcacttaacgaagggcggccagctgatcatcgttttacaaaagaagcagggggcgccatccgcaaagaaattaatggcggaaacttttggcaacgtaacggtattaaagaaaaataaaggatattacattttaagaagtgaacatgagtaaattaagtgaagcagaagtgcaattttatatgggagaggctttaaaggaagcccagtttgccaaaatgattgatgaagtgccgatcggagccgtagtggtgcacgatggcaaaattattggccggggacataacctccgggaacactcccaagacgcgaccacgcatgccgaggtgttggccattacggaagcttgcgcgtatttacgaagctggcgtttgtgggattgccaattatttgtcacgattgaaccgtgcttgatgtgtagcgggacaatcatcaattctcaaatcccggaagtgtactttggcgcacgggatccgaaggcgggcgcagtccgaagtttgtatacggtcttagaagatcaacgtttaaatcaccaggtggaagtccgcgaaggggtggctgcagaccaagcggccgggttaatgaaaagtttcttcaaggcaattcgcgaacgtcgaaaaaaaaatcggtaaaatagtggaaattttattaaaattcgagtatcatagttattgccgtaaggccttggggcaaggttggacttacgaattgtgtcaggtccggaaggaagcagcactaagtatgctctggcttgtgccttaagttattgagcaaatcaacggaactcttagtccatcggggctaagggttctttctttaaaaacagaaatcggggaaggaaatttaatgagttatcaagcattgtaccgcgtttggcggccgcagaagtttgccgacatggttggtcaagaagtggttaccagaactttgaaaaatgcgttaataactaagcagactagtcatgcgtatctgtttacgggtccccgggggacggggaagacctcggcagctaagatttttgctaaggcggttaactgtcattacttaaaagatggcgaaccgtgtaatgaatgtgcgacttgtcgggcaatcacggacggtaatttaaatgacgtgattgaaattgacgcggcctcgaacaacggggtcgaagaaatccgtgatatccgggataaggccaagtatgcgcccacggaagcagactataaggtttacatcatcgacgaagtgcacatgctatccacgggagcctttaacgccctgttgaaaactctcgaagagccaccgactaacgtgatctttattctggcaacgaccgagccccaaaaaatcccgctaacaattatttcgcggacccagcggtttgattttaaacgcatcaccccgacccaaagttacgaccggatggtttatattttggaacaaaaggggattgaatacgatcctaaggcgttatcaatcattgccaaggctgcggaaggcggaatgcgggatgcactcagtattcttgaccaggtcatctcgtttggaaacgaaacggtaacgatggacaacgcgttgctggtaaccgggagcgttaaccagcagttactggatcaatacctaacccagattttcgaaaaggatactcccgcagcgttagaaacgttgcaccaaattttggacgaaggtaaggacggtcagcggctgattgaagatctgattgcggtagaacgcaacctgcttttataccaagaagatccccaactagttaaggaacagagtttgagcgaccttagtgaagactttgtcaaagaagcggacatggttagcggcagcgagttgtacgaaatgatcgacacgttaaaccagattcaacaacaaatgcggtttacaacgcaccctgacgtttacctggaagtgttgacgattaagctctctcaacggtccgcaacgccgacgagtgcgacagcagataacgaagaggtgcaacagcttaaaaatgaagttgaccgtttgcagggggaggttaaccgcctcaaagagcgaacaacttctgccgcctccgcgcctgctaaaccagcctccgcagcgccgaaaaaacgggcttcgggaagtcgcaacgtgaagacgccggccaacctgactaaaatttacccgattttggagaacgccactaaagatagcttggtggaaatgcaaaacctttggcgcgacttgatggatatgctatcggtcacgaaacgagccttgatgcacgtttctaaaccagtggctgccagcgaagagggcgtcgtggtggctttcgattatgactttttgtttgaaaaggctgtggataatgaaagcttgcgtaacgaattacaacaaaatttggctaagctaactggttcagattatcaagttgtctatgttacagttgaagagtggccaacggtgcgggcagaatttattaaaacgcaccatttaagtaaggaaaccgaaagtgcatctaaagaggaagaaccgtcccaaccaacgacggtggcccctgaagatagcgccgtagtggaaaaggctgtggaactattcggttccgaaaacgttaatgtaaaaaatgattaaaggatggtaatgactatgcgtggtggaatgggaaacatgcaaaatatgatgcgtcaagtacaaaagatgcaaaaacaagtgacggaagaacaagaacgactaaacgaaactgaattcatcggcgttgcgcccgatgacatggtgaaggtaacctttaccggaaaccataagatgaaggacatcgttattaatccagaagccattgacgaagacgaccccgacatgttgcaagatttagtagttgccgcggttaacgacgcaatgagcaaaatcgacagtgaaaccaacaagaccatggggaaatacactaagggaattcccggactataaaagaatcgtaggtgagtgtccggatgcaatatccagaaccaattgctaagttaattgatagttttatgaagttaccagggattggctataaaaccgcgacccggttggccttctttacgcttgatatgcaaaaagatgatgtgacggacttcgccaaggcgttaatttctgcacaacgtgacttacgtttttgtagcatttgtggcaacatcacggaagacgacccttgtgatatttgccaagatgcaagccgggaccaaaaaacggtcctagccgttgaagattccaaggacgtaatgtcaatggaacaaatgaaggaatatcacgggctttaccacgtgttgcacggcgtgttgtcgccaatggacgggaaggggcccgaagatattaacatcgcgagcttgctgacccggctccagaaaaacgaagcaatcaaggaagtaatcattgcgactaacgccactcccgagggagaagcgaccgcaatgtatatctctcgattgattaagccttcgggaattaaggtaaccagactggcgcacggactttccgtggggagtgacattgagtatgctgaccagatgactttgtataaagcggtcgaaggtcggacagagatgtaatgatccgagcacggtaagctaatttaaatgggaacttctaaagttccggtcgtatcaaagagcttcatgactacgaaattggtcatggggctctttttgatttaacgttggttcttttgaccagggttgttagaatgaagtgggagctgtggaaaactttttagtttacgaacaactgcactcctcccagtaaggctgtgcaaaacttaaccatttggtggcaaatacaaaaactgtgggattaaataactgaccggagaaatgcattgcgccaactattttaaaaaatttaaaatatcgttgctgaccggcgtaccaaaggctaaactaggacgagtttttagagtagttaatagacagtctagaaaatctaaagtagaataaaaataatcaatataaaaaaatcataaggtagggaataactggtgaatgggcattttatttcatttgaagggcctgacggggctggcaaaacaacgattttggaggcgatggtggagcattaccgcactcgacttgtagatcggttgacggtgactcgcgaacccggaggcaacccgatttcagaggcaattcgcgcaattattttggatagaaataacacggaaatggatgctcgaacggaagctttgctatatgcagcagcccggcggcaacatttaacggaaacaattctaccggcgttagcacgcggtcaggtagttttctgtgaccgttacgtggatagctcgattgcgtaccaaggagccggacgtgaaattggcccggaagcagtctaccaaatgaacttgtttgctacggaggggtgtttaccggaaaaaactatttatttagacgtgagcgctgaagtgggcttaaaacggatcatgactcaccgcaccgacgatgttgatcgacttgatttagagcagcttgattttcacgaacgggttcgtgacgcctatttagcattagccaaacggtatccggaacgaatcgtggtgattgatgctagtcaatcaattggcgacgtaaaaaaagcagttatcaatgttttagaccaaattttaaaatagtgggggaaacacattatggcaaccaaattagttattgcaattgttcaagataaggacgctaaccatcttagcgatcaatttattgaccaaaacatccgggcaactaaattatcgactaccggaggatttttacaatctgggaacaccacctttttaatcggggtggaagaagaacgggttccaatggttctagataccattaaaaaggctagtcactcccgggaagagttcatgaccccatcggtaaatatggacgtgaatatggaaggggcaaccgggtacccaattaaggtccaagtcggtggagctacggtatttgtcttgccggttgaccaattcgaacggttctaaacggccttgacagcagcagtaaagaattcggccgtaactaaacaacccgcggtcatcgaacgttttcaacaaatgattgaaaatcgccacctcgcacacgcctacttgctaaccggcgcaagcggaactggcaaaaaagaggtggcccggtgggttgccgagcggctattttgtcaaaacttacaagacgggatgccctgtggaaaatgtgaagaatgtcatcgaattagtactgggcagcatcccgacgtagtagaaatcgaacccgacggccagtcgatcaaggtcgatcaggttcgatttttaaaggccgaattttccaaaagcggggtcgaaggaaatcggaaggttttcattatcgaccaggcgcacttaatgactaccagtgcggcaaatagtttgctgaaatttattgaggagccggcggggaatgtgaccgccttcttactcacggaaagcaaaaatttaattttgccaaccatcatgtcgcggacggaaattatcgagctgaaaccgcttcagaaaagtcagctagttgctgaactaactgcggacggtgaggtaacggagagcaccgcccatctgttagttcggttgactagcgaccgtgaagaaatgcagagcttgttagaaaataattggatagaagacgcgcataaggctcttgaaaaatggtttggtgccgttaccaagggcgatatgagtgcatttgtggacgtccaaactcggattattggactagctaaggaccgggaacaccaagcaattgttttagacatgatgatgttgtacgcgatggatttgttggcacttaagtttggtcaagccgaccttacgtaccttacagatcaagcagcgctacgccaagtcgcggagcaaacaacggtcagccagttgcttaaggttagcgatttactattgccgttacgcgggaagctaaagcagaatttgaattttcagggaattgtggaaaaagtgacaattgaattatgtgatatttttaaaatgagagggtgatagtgtggagaagaaagatttatttgatcaaataacagaagttacgcacaacgctgaggatttgttaaataaactacacgaaacccaaagtgccatggtagaaatcatggaggaaaatgccgaacttaagattgaaaaccaacacttaagggagcggcttaaacaggccactgccgcggaacacgaaaatgaaggaaccaagaatacgaagcacggtttatcaaaatcattgcaaaatttggaaaagctttatgctagcggctaccatatttgcaacgaattctttggcaagcaccggcaagacgatgaagaatgtgctttttgcttaaccgttatttatggagatcgttaatatgttaacccaaaagagttttaccccgtcatcggcggggtctttatatttagtgcccacccccatcggaaatttagatgatatgacgtttcgggcggtccagatcttaaagaaagcggacctgatccttgcggaagacacccgcaatacccaaaaattgctcaaccattttgcagttgacaccaagcaaatgagttttcacgagcacaacactcaggagcgaattccagcgattttagaaatgttagcggatggacgcacgattgcccaggtttcggacgcagggatgccctcgattagcgaccctggaaaggaactggtgcaggcggtcgtaaaagcgggcttaaaagtaattccgctaccgggagccaatgccggaaccacggccttaattgcttcgggattagcgccccagccgttcactttttacgggtttttggcgcggaaacctaaagaacaacaggcggaactagaaaagttaaagaaccatcccgacacgttgatcttctatgaagctccgcaccggttggcaaaaacggtgaagaacatcgccaccgtaatgggaacggaacgacaaatggttttagcacgagaattaaccaagcgttacgaagaatttatccggggcagcgtagcagaagttcaggagtggattgcgtccacggaaatccgcggtgaattcgtggtaatggtggcggggaacccccatccccaggctgtggaaaaccaagactgggaatcgttaactattaatgaacatgtgcaaaagattattgatgaagaaaaagtcaaaccgaccattgcaattaagcaggtcgctaaattacgcggactcgccaaacaagaggtctatgacatttaccatcaactttaacttataatgcaaagcagtatttaggagagaaaaatggctggaaagatacatgaagaagaacacttggtaacctactatgaaggcgaccaaacgggaacgatgacggtttccatgatggtaaacgtaatgctgttagtatcggataaccaaagccaagccttaggcgtcggtcccgaggtggtggatcagaccgggctaggttgggtcatcacccagtacgtaatgcagctacggagattgcctaacgtgggcgaacggatcgtggtggggacccaagcggtgaaccacaacgactacttctgccaacgggatttttggattaagaccctggatggggaaaagattgtggaaactaccgcgatgtttgttttgatggaccgcactacgcgacggatgcgcaaattgctgccagaaatcatcgacccgtacgaatcggattacataaaacgaattgtccgattgcctaagttacaagaaattaccggggaaacgaaccagcaggactacgccgttcgttacttcgatattgatatgaaccaccacgttaacaacgcacgttattttgaatggatttttaataccgtggatgacgatattttagataactacttccctaaaatggttaacattcgctatcacgtcgaaattcaacctcaccaaatggtgcatagcgtcgttgagtttgaccgggacagtttgcaaagcagtcatcaaatttcggtaggcgacaccttatgctgtgaagccaatgttgaatgggcacggcgttaagggtacaattaacttgtttatagtttggaatggaggagaagttaatgagtatacttgtagtagggggcgccggttacatcggctctcacatggtgaaacgactaattgaacaaggccaagaagtagtcgtggtggacaatttatcgactggtcaccgaaaggcggttgacgaaaaagctcgcttttacgaaggcgacatccgcaaccatgtgtttctaaagggagtttttgaccgggaaaatattgataccgtggttcattttgcggccttttcaatcgtgcccgaatccatggaaaaaccgttgaagtattttgacaacaacaccgccggaatggtggcgttgcttgaagaaatgcgcgatcacgacgttaaacgaattattttctcttccacagcggcaacgtatggggttcctgaaaaatcaccaattgaggaaaatgatcgccaagcaccgatcaatccttacggggaaagcaagttaatgatggaaaaaatcattcgttgggctgaccaagcttacggaattaaattcgtggcgctacggtacttcaacgttgcgggggcttacccagatggttcaatcggtgaagatcatggtccagaaacccacttgacccccattattttacaagtggcggccggtcaacgagaccaattgaagatttttggcgacgactacaatacgcctgacggaaccaacgttcgagactacgtacacgttttagacttggttgacgcccacattttagcgattaactatctcaaagctggcaacgatagtgacgtattcaacctcggttcttcaaccggtttttcggttaagcaaatggttgaagctgcacgagaagttactggcgaaccaattccagctgaaattgccgaacgccgtcccggggatcctgattcactaattgcggctagccaaaaagcgcgggacgttttgcaatggcaaccgcaatacgacgatgttaaggaaattattcaaacagcgtggaattggaagcaacaacatccccgcggttatgaagatcgttaaattttaaatacgtttttatgatgattatagaaaacaattgataaaacattttacaatagaggctgagaaaaattttttctcagcctctatgcgttcctatagttgtcggaagccggtttctgtaggataatgtgagaagggactaaaagaggagcgaactaaatgaaaattttagcattggatacgtccaacgttgcacttagtgtagtagtacttgaaaatgatcaattactggcgatccaaactactaacattaaaagaaatcacagtaaacagctgatgccaattatttcacagacgctaaaaacggcagaagtttcgttagcagatttagaccgcatcgtggtagccaaaggccccggttcatacaccggattacgcattgcggtcaccacggcaaaaactttagcaatgacgttggaaattgaattggtcggcatttctagtttagcaatgttagtgccaaacgcacctaacgacggattggtagttccgttctttgatgcacgcaaccaaaatgtttttgcgggaatttacgaaaagcatggtatggaagttacgccggtggttgccgaccagcacctgagttttgaatctttgctggcaaaaatcaatgaactgggacgatcggtttactttattaataaccattttgaaaaatttcaaccgatggtagaagacactttgcgagtaattgctgagcattcgaccacgttgaatagcttgccgaacgcctacgcgctaggtttgctaggcttgcaaaaacaagcgttagaaaattactatacttttgtaccagcatatttacgagtaactgaagcggaaagaaattggaaggaaaaacatccaaacgatgagagtaaagaatcatatgttcgacaaattaattaattgggcacaaggaaccttatttaatcgaacgcgccggctaagggaagaagccttcgaaattgcacatcataacgtggtgattgaaggacaaagctactttgtggctcaggcaactaatacggacatccctgagattttaatggtggaacgggccgtgtatgatggacagactccctgggaccggacggcatttgcaaacgagctaagaagaaaggtcgaccggttatacttggtgattcgccataatgaccagttgatgggctttatcggggcttcatttaacgaccgggcgaagactgcccacattaccaacgtggccattcttcccgaataccaaaatcaagggattggttcgtttttaattgaagcaattgtgcggaaggcccagtttattgagtataagaaggttaccttagaggtgcggaagagtaatattaatgcccaggcgttgtatttgaagattggttttgaaaacgtcggtttgaaaaagggctattactttggtgaccatgaggacgccatcgatatgcaactagatttatcgaaatggcggggaggatatcgtggaacaagatagtttaatattagcaatcgaatccagctgcgatgaaactagcgtagcggttattaaaaatggtgacactattttatcaaacatcattgccacccaaattgacagtcaccaacggtttggcggggtggttccagaagtggctagcaggcaccacattgaacaaatcaccctgtgcattgaccaagcaatgaaacaagcacaagtccagccaacggacctaagtgcggtggcggttacttacggccccggactagtgggtgccctcttagtaggggtttctgcggcgaaggcctttgcgtttgcaaatcatttgccattgattccggttaaccatatgatgggacatatctacgcagctcggttcgtcaaaccaattaaattccctgctttagcgttgctggtttccggaggacataccgaactagtatatatggcagcggaaaatgaatttaagattattggcgagacacgtgacgacgcggccggagaagcttatgataaagtaggtagggtaatgggattaaagtatcctgccggcaaagcaattgatgaattggcgcaccaaggacaagatacgttccattttccacgggccatggagcacgatgacaactttgactttagttttagcgggttaaagagcgcgtttatcaacacggtgcaccacgcggaccaagttcacgaagaattggataaagcggacttagcggctagttttcagcaaagcgtggttgacgtgattgtggccaagacggtccgcgcttgcaaagcgttagaaatcaaacagttgattttagcgggcggcgttgctgcgaaccggggattacgggatgccttagaccaacagctcagcgcccaatttaatgatttagatttcgtgaaggcgcccttaaaactttgtggggataatggcgcaatgattggggcagccggcgaaatgctgatgcgtcacggagtgtttgccgatttgacgcttaatgccgatccgagcctagagtttgattgggaaccgggcgcgactaaataaaaagaggtggcaaagatgactgagcaaatgcaccagattcatcaggtgattgaaaagggaattcaacaacactatattaatggagcttcgtacagcttcattttaccaaacgaaattgaaagccgttacgaaggcgtgcagggcggtaaggaaggcaacgtgtgccttgatccttcgatgatttacgacgtcggttcaatgactgaagtaattgcgaccacgacccggatttttcagcttttagcgattcaagaaatccgactgaaagatccgattaaaaagtacctgccagggttttccaacccggatgtcctagtgttgcatttgttaacgcacactagtgggattccagtggaaattccgggaatgtaccggttgaccgggattgaatttatcaatgcgctttacatggttgacacggattttgagcctggcgaccacgtgcaagtttctccgttaaattttgcccttctgggaattatcattcggacggtggacggttccattgaccgggcggtacaggacaagattttgtatccgttggcaatgactaacagtgggtttaaccttaaccgccctaagatgcgttttgtgccaacgagaaacgatcctaaacggggacaaattcaaggtcaggttgaagatcagttaggattgttgttaaatggagaaagcgggcatgcaggcctattctcaacgttaaatgatctaacggttttcaccgaaatgatgattaatcggggaagttaccaaggcaaagaaattcttgatccgcagttatttgatggaatcaagaaggtggatgtggacggccaatcgctcggctggtgccgtttcaaggaaaaccgcgatgtcttttatggcagcagcccaaccgggttaattgcctttaataaccaaaataaacatggtctcgttttgctacacgattatatcgaggatgaaaaggtccacgtggcaatgcgtgacgaaatattaaaagttgttcaatagaggatgtggaaaaaatggctaattttaaactttcaattccgaccacccgtcggttacctttgtattaccgctatttgcggcgtttatcagatcaaaaagtagaaaaagtttcttccgcaatgttggctgaatatttacaaattgatgcagcaaccattcgacgggatttttcttactttggacaaatgggccggcgtgggtacggctacgatgttcaaaagcttttggaactctttgatgacgcgttaagacaagatattaacgcaaacgttgctttagtaggggtagggaacctcggacgggcgttactaaacttcaagttccaccgggttggaaatgcacggattaccgcggcttttgacgttgatcctaaattggtgaacacggtgcaaaaccaaattccagtttatgacattaaaaacctaaaggaacaaattaaagaacaacaaattaccgtggcaattttagcggttcctgcagaaaaagctcaagaacttactgaccagctgctagaagttgggattcaaggaattttgaactttactacggttccactgaccgtgccagaaaaagtgattgtgcaagacgtggacctttctgtggaactacaatcgctaatttacggaattaaccggcgggaaattgaagaattagaataaatgtattgaaggcttactgtttatatattgcggtaagtttttttattagcttaagaatgggttatggatacgtggtttttaatttaaaagataggtgcataagtatataaaatactaagatagtggaaaaatcttaggtttgctaagaaagggatggctttttagaaaaagttggcatcttgctagtgaactttaatttggttgagtttcgtgctcgttgactcaaaaaaagaccagaatttgtgaaaaattctggtctctttttattttgtaattaatcaaatttataactcgattagttagcttgagcgccacacttgttgcagaacttagcaccttgagcaagcggtgcgccacaactactacaaaatgcgctcgctgatgatgcagcattatttgcatctccgcttacggcgttaacaatttgttgtgtgttttgagctccttgttgaattgtgcggtccgtttgtgctcgcacgttgcgatccgcttgatatgtagctaatttttgggtgagtttttcttctaattcttcactatgatgtgcttcgaagaaaggtaagtcaattgttttactaattccggaacgttcatagttaaacgtggttctgattccactaccaattaaaagcaccccaacgataattgcgattagtgccgaaaagaatgatgagcccattagcgctactccaataattgcaattaataatcctaaaaagattgagctcagcttatatgatttcgatgtgtatacgttagtaattcctgaaaggggagatgaatctttttgcttaccggcaggaaccaaaccaaagaaaactgtatttggcatatttacccgtaagaaggcgtcatctagtgtaatacttccctttacccaaaacgctaataaactaacggaaaacgcatcgctatcgttttcaacaactgcagattgtaccattattattcctcctaaattaacagatataaccattatatattcacgattaaggttttgtaaacctcttttacaaagtattagcaggagaaacaagcctgccctgctgcatcaataaaaaaactaggaaatttatctaactttcctagtcttcttaattagcattaacttattttagtttcaaaccagaaacttccaagttacgttcgtaggtcttaatggaatcactaagggtagaaacgttgtcatcagaagtaatctttttatctttgatgtttaatttaccatcgtttaacgataggttgtttacttcaacggcaacattttcaggttcgtcatcgtcatctgcgtccgaagagttgacgctataaattgcaacaattgataatttgttgctagatgaagtactattttcggatgcatctgcgacttctactttgcttgaaacttcgttggcgtcgtcatcgtagtattcttcttcattttcgttatatggagttacgtacaagttaacaaacttggatgtgtatttttcatcagcgaattgtttgtcatctgtgtaatcagacatgacagtgtcggtggcatccgtaatgtcgtcaacgttagtaattgatttactatcaattagtccggaaatcttatacttgaacgttcttgaaccagtgtattggtgcttaccactactatctttaaaggctgcttttggaagcgtaagtgaaataacatctccgttgctaaggtgaccattgttttaaaccttaatgttgctgttgattaagtcagaatttttacttgaaagtgcaatttgtcccttgccattaattccgagggctttgattttaagttggttaaaaatcttattggaagaaactttggtagtttttttcaatcccttaactgtgaacttttttttgccgtcacggaaaggaagttcagaattgctgtttttaaacattacggtaaccttatcgccatttttaagttcggttgatttccctttgaattctaatctagtcgaagaaaggtcctctattgatgattgaattttatattgatcttctgaagaaagcatactgtaatcaaatgcgtcaggatgagacacaattttattaattacgtctttttttatgtgatccttttgcaatacgcgccgggtcatgtacttatttacggattcggcgttacttattaccgcatctccatgtccgttataaccatagaattttacttcaatccgggaaatgatgttgttgctgtggtagtcgtatcctatttttgcacctgcagcaatgataatgattgcaatcacgccgtacactaattttttattttgggtaataaatgttttgaatttatccattgtaatctcctttaattatttcaagacaaagtagagcgtcacactataatcgtcatcgactaattcactagcgtcatcgtatccagctcccgcaaggactttcttcaagtcaatattcgcccgatatgcaggatgccctttaaaagttactttatgagctgtatcgatggtagctaagcgtactccccagctcttcaagaaaaccttgcttcccttagcagaccacttaactttgccaaaaccatccatgctgtcttggttacctgaaaactttacttcatggtcaggtttgaaaaccgcttttgcggatttatcgtaggttacgtcatcatcagcacgcattccaaccgtcatgactttgttttgcacggcgtattgaccgcgattggcataacgataaccgccggcaatggcgattaagattacaacgatgatggcgatccacttatgttgtttaataaaattcattccttaactcctccatagtattttggttaatataagtattttggcgaccgtcctcgatactttaactactagtccagatcgtaccttttaagcaattaatcctaagtagatataagggctttaataaacacataaaaaattcatttcctagtaaccgaaaaaataaatactaaaaaatggatttggataaggtgattgatttctcaaaaggtgacaatgactagtgattaatttcttaatacgcaaacaattcaatgaaagacataattatttacgttactaacctgatattccctccctataaaaattttaggtattagtaccgtagacattataaaatgttatcactaatgtttttgtattcatatagatgaaatgaaaaaatatgtattattttggggtttgttctaaatggtagactaaatttaaatttatgaaatagctactaaagccagttaaaaggggtggtgtattgacttttaggggaaggatgcctagattttaaggatgatgactgttgtttttttgttctattttatacactttttatatattaatataatattgaaatggtattgcgtaatagttacactttaaaggtatgaggaagagtattaatacatattaaggagtaggattatggaaactaaaaagcattttaagatgtataagagtggcaaaaaatggctcgtagcggcaattgtcgccggaggaatggcaacagctggtagcgtggtaagtgcgaatgccgacgaagtcgcaacagctaacgctcccgcacaaacatcccaaactgaacaagttcaagaaagcacggcggccgtaactagtgcgactgttaaagccgacagtagtgctgcaaattcggttagtgcggcttccaataaagtaaatagttcagcagccccaactagtgcgacagcctcaagtagcgtggcttcaacaccagtggtcaacaaggccaaagatagtcaaactgaaaaaaatgcagttgcagatgataagaaagatataaatgaatctacagctcacaattctgaagatagccaaaaggatgtaaagaataacgatgtaactaaggaatccgcaaaagttacgcaagataataaaaaagattccggtacagtaggtacggtaaattggacccttgataaccaaggaactttacatctaaatagtggggatttagagcatggaagatatgataaaaattggaataaaaatgatgtaaaggtcattcaatttgatggggaagtcacatggaattttgaaacttttggagactacttttttagtgaatatgaaaatttaactaaaatcattaatgcagacaaattaagctttggaagctcggaaacaatttcatttgctgataacccacaattaaagacgattgagggaattgaaaaatggaatacaagtcatctaacaaggttagcatctgtttttcaaggagatagtagtctaaataatttagatttgtcaaaatgggatacaagtcaagttgaaaatatgggggttatgtttgcccaatgcagatcattgagtaatttaaatgttaagggatgggatgtatctaaagtacactcctttaacagtatgtttagtatgacaactagtttaagtgatttagacttaagtagttggaaaaattcggcgactagtgaagggcatgattataggtccatgtttactggttcaggtattgagcatttaaacttaggtgggctttatattgatagtaatttagattttactgattcaaattatctaaagagtgttacggttggtccagttacctcgaatgtgtactttgtgttgagagctggggatgataaaaaatggaaaattgaaagtacgggtaaaacctatacttctgatgaaattgaagacttcctcaataaaaacggtagtgacaaagcagagacgtatacgttagttacaaacgacgataatcaaccaaacaacgataaagacgactctcatagcaataattcaggtcagaatgatggcaagaatgataccaacaacaataagccggatcaaaatgatggcaagaacgataccaacaacaataagccagaccaaaatgatggcaaagacgatgctgacggtaataagccagaccaaaacaacggcaaaaacaacgctgacagtgaccaacctgcacaaaatgatggtaagaacaatgctggcagcaatgcatcaaatgcaaataatggaaagcacgctaatggagacgacactgctgcaaataatgcgcaagcaaccgacactaacgaccaacaaaatggtggggtaattgttgattcaaatggtggtattaacaacggtagtgccactgatcatgctggcgcacaatcaaatgcggtgtttgcgccacaagatcgtgcaaacggccaaacccgttctaaacaatctaaccaagcaactgctaagactttgccacaaacgaatgaaaagaaacaatctacaacgttacttagcgtaattggcttagcaatgttaagtctattggcagtagttggcttagttaagaaacaacgcaaaaactagataatcgaatttctataattacgaacgtattaaagggcgaattcaggatttctgaattcgtccttttttgcatcgatcttgcgaataaatccgtaggcaagaggttagcgagttatcctagctttgccatgattagccaatctttaaagacaggtagctcaccgcggggttaacaaagtaattagctttgttaaagcactacaaagtgtgtcgatcggtattaacatatgcacgtataataaacgataaagaagcttaagaaaaataattaaaggtcggaaaatgccgtcaaaaaagcattttaagtatcaaaaataaaacttttagtgctaaaaaataaagtaaccaggtttaaagaataaggaaaaggtgcggtaagtcaccgatatgcaattactactgttttaggaaattaatggtggactagaaaccacttaatctaaaattaataacggtctttagcgcattttttaaattctagaaaggagcgaaagactctatttagtaacgctgacgtatacttaaggagtagctactaacaaacgaggccgggtaaaacggtttattcttttcatagtataatcgctactagaaattattttttaacagcggtaaaatggttaaaagtataataaacgatacattaactttggtagacaaagattgttcggaatcgaatggtaaaaggttaattttttggtaaggttcggggttttgaggcggtaaaatcgcgaaccttttttgattgtaataatatatgtatattgtctagttgactatattttgttatcaacagaaccaaaaacctttattgtcgacttataacaagacgcgaggtgcaatatgagtgcaaatataaatattggaaaattaattaaacaagttcgtaaggagagcgggttgacccaagaagagttagctgagaaaagtgatttatcagttaacttcatttcgcgaattgaaagaactgataaccaaaacattagctggaagaatatcgaagcaattgctgaagcattagggttgagtacaattgaactattacaggtcaatgaaaatcggcaacagcatcggggattatatttaactaagctaatgcggattttagaagatatgaatgaattggaagctgaagagttgtctaagaacatcattgatattattgaattactacaacgaaaaaaataacggttagcaatgtagcgtcggagaagttactcgtgccttagtaattaaaataaaaattatttattgattagaccgcaaaacctgcacaaggttttgcggtctttttaatacttttatcgataaagcgcatacatagtttatatgctttgctataatacccatattcaatgatggggatgtattagaaagagggagtcattaatgttagaaattgaccaggttagtaaatactttggtacatattgtgccgtcagtgaggagtcttttgtggttcatccaggtgaaattttaggtttgattggtcaaaacggtgcgggaaagacgactacttttcggatgattttagattttttaacgcctgatgaagggcaaattaggtgggatggaaaaccaattaaccagttgaaacgcgactggattgggtaccttcctgaagaacgggggctatacccgaagatgactattgaacagcaagtactgttttttggccagttacacgggatgaagaagcacgatattttagctcagctagatgaatggatggatcgtttccaagttaaggggaaacgcaaagaaaaaattaagaacttatctaaaggaaatcagcaaaaggtccagctgattgcggcattgatattcatgcctaagctggcgattctagacgaacctttttcagggttggatccggtgaatgcggggctattaaaagcaggaattcggttcttacgacagaatggtaccgcgattattttttctagtcacgatatgacaaatattgaagatttgtcggatcagctggtgatgctaaaggacggcaaagtagttttaaatggaaaggtcaatgaaattcgccagcagtttggcgatacgcgggtgtacttgcagacaaaccgattcacccaatcagagctagcggccattccgggggtacaacgggtaagtcaaagggcagaccagtttattctagaattagaaacgcccgcggtgggccaccgaatttttgaattggtaactaaggatggctacctaaaagaatttagccaacaaccgcctactttagacgaaattttcaaaattaaggttggtgactaagatgaataaattaatgattatcgcaaaacaagttttaaaaaagaacgtgactagtttttcttggtggtcgctggtcttattgccgctgattatcgcggggatcatggtgggaattggtatttatagcggacataaagactctaaagctaccgtagcggtggtggcgccgtcagaaattgtacaggaactttctgctacacaacacgcagatttgcgctatcggggatactcctctaaaaaggatgctgaacgagcgctaaaaaacactaaggttgacgggatcctaaccatcgatgcgcgtatgcaacattcaaaactaacggtcaataaagagggggccgacgttgaagagaccgacattcaacaagatttagcggttttaaatacggctaatacggccaaagcactcggtttaagccaacagcagctagctcaattgttacggactccggagctaactacgaaaacggttagccttaagaagggacggttaaccacgatcaattccggcaaccggcaactcaggatgattgttgcccaattaattgcgttaccaatgtacattttcttaattagttatggaaacgtaattgcccaagaaattggtacagaaaaaggttctcgaattgaagaatcaattttaaccgcggtgaaggcaaaaacccaattttacggcaaattgcttggcgtggggattttgactttaatccacctactggtttacctggtagttggggtggtggtttggttaaccagcggccaatctggcaaactacacgatttaattaatcaaatcccgtggcacgaaatcgatttgccgttcctcagtatttcaattggctttttcatcttgggggtctttacgtacgcaattttagcggccctttgcggttcactggttaccaaccaggaacaaattgcgcaagcagcggtaccagccactttaatcgcgatggtgggcttcttcgcggcaattcaggctccggatagtcaagggatggtgacgactgtgctaagttacctgccgtttaccagtccgatggtaatgccggtgcgttatggcgttgaccaagcgagtctgagtgcggccggggtggctcggattattaacgtgattttcttgctagctttttgttggttaagcgcgaacgcttacgagcgcaacgtgcttgtttataacaacaagggaatttttaaggcgttgcggcacagtttacaaatgcaacgtaaacgtcattaaccgcaaaaagagagaaaataaaacttggaagtttgcgagtaggcaatcagccttagattttgcaacgcttactatcgatatagagttaactaaattaaaacgctccttaagaaattaatcttaagaagcgtttttttaattctttgagtcgttaactaaaattagtcgtttaaattgtatcttaacttcatgtgagccgaacctaaagtaaccatttcgccgagtagcttagtttgacgagtgaaggattcgtgagctaatttttcgttagctgcttccaaatacttcacgggatcgctttgcgtagcgaagttttggtcggtttcattttggatatgccggtaagcacccattgcttcaagttcaaaggtgttccgcaagtcaacgtacagatcgtaatcggtatcgccaaggagggcggttgtgcagcttaaccagtacatgttgttaaggtcgaacgtgccggtggcatttttataaacgtccggggtatcgttgacgtttgcatagaatggaaccaccgtgttaaatgtgttggccccgtatgctagccagtggataccggtaatttcagcgggcacgtcgttacgaatttgcaagatatgcacgttgtggttccggttgatgccgattggccggaagagtttcttttggtcttcggtaccgttaccgtaagggtcgtattccgtattttcaaaatgcgaactcaaaacaaacttaacgtcttcaattgaaatcttcttgtcggcgtggcaaatgaacggtaagtcttggtccatcgggtcgtgttcgatttccggattgaagtatttttgtccgtaccaagtccgcggattgttgtaaaccgtgtctttaatcgatgcactaccgaaaatgtggcggaagttgtacccatcgtagtcgggattaaggtgatatttttcgatcaaatcttttaagtctgctgagcacaaagtgtcgtcagaattaaagtcaaagtggtcgatgttcatccggttaggagcaactacgtaagcatcgtcaggaatccgtaccgctgcccagtgatgtccgccgatggtttcaagccaccaaacttcttccttatcagaaaaggcaattccgtttggttcgtaggttccgtattcttctaatagttcacccatccgcaaaacaccttcccgggcgctgtgaatgtatggtaaaactaacgtaacgatgtcttcttcgccaatcccgttttctacgtaaggatcaattccaagaattcgggaattagtggtgatggtttcggtagcggacattgcaacgttttcgctgttgatgccggctgccggccaaattccgttcgttaaaatggagtttggcatggaagtgtaacgtaatggattatcgggaagcttaacttccacgccgctgattacggcacgataattttggggttgttcatcgggattaacaacgacaaaacgttggggatcgagggcttcatggccgtcgtcgttccgtgaaataatcgttgaaccatcgatggaggcctttttaccaactaagatagtggtacaagaaccgtgaatgcgtttgttcattgataaacactcctttattattttatatgttcattatataacttttgcacaaaactcacaggaacaataggcgaacaatatttattcgaaataccctttaagtgaaataaagttcgttattcgtctttttaaaagccgattattatgctaaaatgttcgttataaactgaaaatgattactgatatagtggaggatgagatgaaggaatttgagtcgcaagttttacaagaagaacggttgtcgacgccaaagacaattctgctggcgtttcagcacttgctagcaatgtacgcgggggatattttaatcccgcttttgattggggcagctttaaaatttaacgcccaacaaatgacctatttaatttccgtggacatttttatgtgcggggtagcaactttcttacaaattaagcggacgccgctaactgggattgccttaccggtggtgctcggctcagctgtggaatatttggccccgatggagcacattggaaacacctttggttggggatacatgtacgggggcgtcattgccgccggaatttttgttttcttaattagcggacttttcgcgcgactacggaaattctttccggtagtggtgaccggatcactaattaccttaattggctttacgttaatcccggttgctttccagaatattggaggcggcaacgttgcggatccgcattttggaagtgctagcagcttaattttaggttttgtaactgcactaattattattttaattcaagtgttcactcacggattcgttaaacggatttcagttttgattggcattgtagccgggtcgttaatcgcggttttgatgggattaattgatccaacgccgatcagtcaagcaagctggttaaaaatcccgctaccgttttactttgcgactccgaagtttgaatggtcctccatcctaacgatgttgttagccgcggtaacttgtatgattgaatctaccggagtttactttgctttagcggatatcacggaacggaaactaacggcggacgatttaaaacgcgggtaccgctcggaagggattgcggcaatcctaggcggaatttttaacaccttcccgtattcaaccttttcccaaaatgtgggaattgtgcaattatccggaattaaaaagctgcgcccgatctatttctcggcggggatgttgttaattttaggattgattccgaagtttagcgcgattgcaacgttaattcctacgtcagtccttggcggggcgatgctagtaatgtttggcatggttggagcccaaggaattaagatgctggcggcggttgacatgacggtaaataacctattagtaattgcggtttcaattggcgttggtttaggggtaactacccaaccaaccttgttccacattttaccggcaaccgtgcaaaccattttagataacggaatggtggttgggtgcgtgacggcgatcatcatgaatcttctattaaatggttctaagggactagacgaaacgcgcgaatcctcagccaaatagcctacgcacgttaacaaaaagcgacagttatgtttggattgggcataattgtcgtttttaatttaatgaaggcaaaaaaataatacagaaaaagaggttggaaaaattccaacctcttttgagttcttatttaacttttggtgtttcagcgattgtatcagtcttgcctttagcaaatttttgaatcgctacgatccgtgcttgacggcgacgacgttcgcgtttgccagaaactttacgtgcacgggcgaatgaattatatggtgacttcatggtcttcctcctcagcaaaaaaataatcaattactattttatgatgaataatggagaaaagcaaataaattattagacggattgccggctagcgttcatccgggtcacaattcgcagtgccaactgaccaaatgcgcgaattaacaccacctggattggcaactgaatgatgttgctaatgatccgtgccgaattgtagtacgcagccgccgccgcgccaaagtaaatcgactgccagatgaagtttaagcccatggtaaccaccaacataacgagaaggcgggcaatcaaaattcgccaccagtcaaacttaccttgatataggaaaaatgattgaatgacgttgcccaccatggcgctaatggcccatacgggaaggtacggaccaaccgggttagaaaagtaaccgaccgtgtcactgaccaacccaaacacaattccagcccaggggccaaacagcccggcaacgatggccgatggaatatactcgaagctaaccaaggtaaactggggcgttagatggatggtcgtgtaacgagccaacactacatctaaggccgccaataaagccatcatggttaggtttcgcacggaaaaaactcccttaatactaaaaaaatccttcatgcaaatccctccatttctttattggccgcaaaacgaaaaggaaatagcatgaaaattccctcttcaacggcgagatgcggaaccgatatcgctgctaggcattcgttcgtcgaacaactctccgtctcgacgacacttaacgcaccgattcctactccattgatagagctaaattcattgtagtcccttttacttgaatttcaaggaaaaaagttttcggtaagcgaatcggaaattagctataatggaaatgagtgaaggaagaaagcacaaacgaatggagaaaatatgcgatatcgaattgaaaataatttagaagaaattattagtgcacaaaaagttttacaacggttaggagccagtcaacggttaatgcaaaaaattcgccaagccgggcggttagttgacgaaaacgaacggacggtggcgttaaaagacaagattatgccctttgagcccttttggattgaactgccggatgaggattctgacccagcggtgccagttagtgatcaaccgctcgacattatttatgaagatgataattggttagtggttaataaacctgcgggcctaactgcggttcccggaccaagtaaccgtacggataccttggttaatcggattaaggggcactggcaagctaacggagcagttaacttggtaccccatttaatcacccggttggaccggtttacaagcgggatcaccctcgtagcgcgtcatcaagtggctaacagccttctaagcgagcaagtacgtcatcgaaagattaaaaaaacgtaccttgcgctagttgacggggtggttagtgctgaaaaagggacctttaaccagccgctaggcctagctgccgatggaatccaccgggaggttcaagaaggcggacaaagcgccacgaccagctttaaagtggtccaacgttttgcaaatcaaacgttggtacaggttcatttaaaaactggacgtactcaccaaatccgcgtacactttgccaacgcgggccatccgttagtgggcgaccaactatatggtggtcccatggatcggggaattgagcgacaggctttgcacgcgcaatccatccgcttttttgatccgttcacgaatcagaaattagagtttacggctcccttgcccgcagacttacaagcaatcgggatgtaggcagttccggacaactttaaacgagcagaaaataattgattgaagaggtagttatgacaacagaaggcaattttgaaaacataaacgtaacgttaggagatcccgcgtttgacgcaatgttaatgcagttaaatcacgaagtaaacagcagcaacgcgtccgaatacaatttcatgggcaacttgacccaggaagtcggtgaccaggtttgggcggttcccgcgtacttaagtgaagattacgccttatttttcctatacaccgcgattgaaactggcgattgggtagtggccttttcggaaggaacgcaaacggacgggcagtttaacctaggcacgccgttgaccactggacagggattgaaccgtttgtacgaaaagaatccgaaccgggcaaagatggttttgagttttgtaaacgacttggaaaaagccggtgaaggcgtgtggcgaatggtggaattgtaaaacaagcccgcaagtttagctaagaatcatttaagaggcccctaggcgatgtttaaacatctggtaaaacgttggaatggccgggaaatggcctagtggaattatgctataataaaatccgattatgaagaagaagggggcaacgcgatggtaacgattttaatcgtaattttgctggtgctggcactaggcggcggattttggcgtcgggcgcaaaagcaccaggaagttttacgagaagctcggcaagcagctaaaaagctgactgcccagcaacaagaagcgacccgccaagcagttcaagaatatcaacaaaaaagtcaccaagaaacggaacagtaccggatgaccattagtcaagaactcgacgatgatcaacgtgataaccaacgcaagggtgcttggattgagcaacgaatgaaattgttggagcaaaagcgcaatgcacttgccaaccgagcaaacctgttatcacagaaacgccacgagttgcaagaccggaaaaatactgttaaggaaactttgaagcaggcggaccagttgattaccgaacgctggcaaacgttgcaaaatgtggccgatttacctgaagcgcaggcacgtgacgtggttttacaagccactaaggaagatgcggaacaatcccaagaagagtttgttaacaatgcggcaaccgaattagaaagttcaaaggaacgggaagcagaagatttgattgcgttggcaatggaacatagtaacgtggtcagcgtgcagtatgaaaatcaccgcggcttggttgccgataaccaagaatacttggggaaaattattggtaactccggacaaaatgtccgagcgattgaagccttaaccggggtagacgtgatcattgatgaccaaacgaaagaagtaatcatcaacggatatgacccggtgcggcgggctacggctatggaagtaattaaatctattaagggtgaaaaacgggtgcttcccgacacgattgaacggctggtgaaccaaactaaccggacgattgacgaacgcattcgacattacggtgaaaatgcggttcgggaattgaagctgaagcacgtggcaccggatttgattaaaattattgggcggatgcattatcgaaccagttacggacaaaatattttggagcattctatcgaaacggctaaactagcaggaatttttgctactgaattgggcgaaaatgctgcattagctcggcgtgcgggacttttgcatgatattgggaaatctattgaccgggatattgaagctacgcacgttgaactgggagtggagctaaccacgaaattccgggaaaacccagtggtgattaacacgattgcttcgcaccatggagacgttgaatctaagtacgtaattgctgaccttgttgaagcagcagacgcgatttctggtgctcggcaaggcgctcgaagcgaatcagcagcagattatttgcaacggattaaaagcttggaagggattgctaatgaccagccggaagtacaggaaagttacgcaattcaagcggggcgcgagctacgggtaatcgttttgcctaaggaaactaacgatcgcagtattaagaacgtggctactaacgttaaggaccgcattgaagatgaggttacttatccaggacaggtcaaggttacggtggttagaaaattggaaattgtagaatacgcggagaaaaagcaagcatgagtcaagataatgtcgaacaattaaaccaaatcaaccattttgtgatgaagaaattgcaaaacgacttgaccggacatgattacgcccatattcaacgggtggtaaagatggcccaaaagttgatggatgatcgtgatgagaaaatcaaccgttttgtggtcattgcggctgccacgttgcacgacgtgattgacgaaaaggttgttgaacaaactaaaactgctgaagacgaagtgacccgttttttgcgggaattggcggttagtgactatgacattgcgcatattttcgatatcattacgcacatgtcattttcggataatttagaacataagtataagctttctttagaagggcagattgtgcaggatgccgaccggttggatgcaatcggggccattggaattgcgcgcactttttattatgggggcgcgcacgggcacataatgtatgatcccgagattgctccgcgtgaaataatgacgcatgccgagtatcggcaaaatcagtcggtaattaaccatttctatgagaagctacttaagctaaaggacgaaatgaacactccattagcccagcaaattgctgaaaaacgcacccagcggatggagtcgtttttaacggaatttattgccgaatggaatcaagaaaactaggaggagttagggatgttacgagatatgcctaatgtgccaaaacgatttgtgatactagcggcgttagtggtaatcgttttggtagcaggggtcaagatgcaaagcatgtttatgctttttgtggaccaactgtttagcagcgccgtacaaagtgaatttatgatgtttttagaacccgtgatgcgactaatcacgatgattgccgacactaaactggggctgatttatgcagtactaattgcagcatacttgtggttgcggcaagggcaacgggttgacgcaatttgggtgatttgcacgatgtttggcggagcagttgtggcgtaccttttaaaggaatttgtcaaacgtccgcggcccacgattgcacaaattgtccctgaaacgggatacagtatgccgagtggccacacttttgaagcgttcttagttttagcgtttctttacctattcttcgtacggccaatggcagaatcatcgttgaaaaaagcttgcaccgccgggttggtaatttggcagattttggtaatttggtcccggatttttatgggggcccattaccttaccgataccttagtggcggttggcttaggaaccgtttggctatgggtggccatcatgttatatcacagcttgtacgatacgatcgctagctacatagaacctagcgtgggtcggcaccaccagcggtagtaattaggatccctaagagcatagttaaagcttacttggatggagtaaagggagttctccacacgataagtgttaatcgtacttatattataaagagcttctcaagaatttttagattcttgggaagttttttaattttagaacgaaattaattgttatttcgagaagtattgaaggtgctttctaaatgaaggataataaggatagttgcagtgggggtgagtttttatggaatttaaagatgacaaagctcaacacggtttgagatttttggaagcgacggttttaaatttagcaatcacggcggttgaattcgggggcggattgctctccggtagtttagcgcttttgtccgacgcgattcacaacttgggcgacagtgcctcaatcgtaatggcctacgtggctagtcggattagtcagcgaaattctaatcagtctaagacttatggttaccggcgggcagaaattttatcgtcgtactttaacgcaatttttttgttagtaatgtcagccctgttaatttgggaagcaattcggcggttcgctcatacgcatccggttaacggcggattaatgttagttgtagcggtagttggtttgttagccaatggtttttcagcgtggttgctacatagcggttcgcacaataacttaaacctaaaggcgacctatttgcatattttaagtgatgcatttgcctctgggggagttattttaggtgcgttaatcatcaaaatattccacgtggtttgggcggacccgttgatgaccattgtggtttccgtctacattgcttacaagacgattccaattatcatcgaagcgactaatattttaatggaggcgggaccacggttggattatcgcgcggtcaaagcaacggtactaagcgttccaggagtggttaatattcatcacgtacacacttggatgattgatgaacaccggattatgctaaccgctcacattgctttagaggatcaagaactcagcgaagttgaaccaatttaccaaaagattagaaaattgctaaaggataagtacaatatcgaacacgcaactttgcaagccgaagtcgatcggggcaaggaatatcagatctttacaactaataaagacgacgtttagcgagtgatatttgatagcgttttaatttttttgaaagaaattaaggatattgctgttttttttgagaagggcatgctatactatagatgtgcttttggttaggtgcttttggtcagattgttttattgtgaactatccccattactaccggctcaagctacaaattttaaaacagccatgcatcatggttttacaggaggatgttcataatggaacaaggtacagttaaatggtttaacgcagacaaaggttttggttttattactcgcgaagatggtagtgacgtattcgttcacttctcagctatccaaagcgacggcttcaagactcttgaagaaggccaatcagttagcttcgatgttgaagaaagcgaccgcggacctcaagccgtaaacgttgaaaaaaactaatttaaaaaattactgaaaaagcagggtgcttcggcgctctgcttttttgtgtagtttggcgaagaaaattatgttataaaaataaaatcattaacgaatcgctggcttattcggtataatgaagaagttaaagcggaggtacggtggatgcgtgatttaaaaaaagtaatcaaaacttgtctgcttgctggacgaataatgattgaaaatggctccgaaatgtcgcgagccgaggataccatgaaacggattgcgattaattcagggattgatgatttacaattattcggtacaattaccggcttgattgtttcagttccggactcgttaacttcccaggtggaacaaattacgcggcgagcctttgatctagagaaggtttctgcggtcaattctttttcgcgagaatacgcggcaaaacaaatcaccttagacgagttttacgaaaagttaagcacgttggatgaagcaacgccgtttttcccgttttggctgcaggtattgggagctgcactggtaagtgggcccttcatggtagctttttcaggaaatttggtggatttaggggtcactatgttggtgggggctctcgggtacaccgtcttttacctgagtaaccgtcttttaaacgttaagtacataagcgaattttttgcctcgatcgtaatcggtattttagcggtcttaatcgttcgaatgggctgggggcaatcgttagatgagattatcattggttcagtcatgccccttgttcccggagtgcccttgactaacgcggtccgggatattttaaacggccatttagttagcggaccagcgcgcggagtggaggccctgttatccgcatgcgcaattggctttgggattgcgttcgtatttcggttcatatgatggaggaagattgatgcagttattattggaatttgtgatggcggggattgctacggttgggtttgggattattattaacatcccgcaccgggcgttgttaaccgctggaataattggtggaatctcttggggaatctactgggaaatgttgcaatttcacttagggctcgcattaagctccttaacggccacgacggtgattgccttactaagtttatttgcggcccggcggttgaaaatgccaatgattgttttcagtattcccgggattgtgcccctggtccccggcggacaggcttaccaaatgattcgtaactttgcgttgtccaatacgcggcttgccacccattttatgttggaagtgggggtaattgcggggtcaatcgggatcggctttttgatggctgagttcattgaccgtttgcaacgtaaattagtagtgcgtttcaaaaaggtccgggaaaataaataagggctaccggtaaacaaaaaataaatgaaattgaaaaacgcctcgcaagggttgtgatactcttgtggggcgttttaattttagaagcttcgcaggttaaacaaaatcaatgtcgaattttaaattctgctttgcagatgttcaagtcaaacgaagtctttttaattgtgtatttattgcttaatagccttgataaccttggtatcccgtagttgctcccgtccctgtactaggcgtagtgggggtaggagttgcttggttgttaggatcattgtagttggaagaagtactgctattatcagcactagatgttgcatcactttcctcaacttcgccggcatacatgctactgattccagtcgtaccggtagttttgtgtggtaaatcaagcgcatcgcgaatgaagttagtaacgcgttgccgttctttttgcggaacgtattcataagaaccgccgttaatggtgatcccttcaccttgtaaatgagttgatttcaaatggtgggtagcaacccgatagttacttgaaagggctagtaactcattaaaggttaaatcggttttagtttgtttttgcagagaatttaagaagttttggttgagcaacgcggtgattgaatcgctctttcttaagatggccatcaaaacttggcgctgccgagtttgccttccgtaatctcctttaggatcgtcgtaacgcatccgggagtaatcaagggcagctttaccatcaagatggattttaacccccttcttaacgtcggcgttgccatacttaaaggttagcttaggggtgacgtcaatcccgcctacaccgtcgacaatcttttctagtccacccatgttgattaatccgtagtagtcaattggaacgtttaacaatttttgaaccgctcgaatggccgttccggctccgccaaaatcataggcagaattaattttggatggtgaataactggaatatcccggaattgacattacggtatcccgggggatgctagtcaaagtcatcttcttctttttgggatttaacgtagcgacgatcattgtgtcggtacgaccacgataattccggcctagcgccccagtatcggtacccaataataggatggaaatcggtttgccgtgttttagctcgctggaaacgtcccgggctttttgaatgcgagcactatcaaaaattgaatcgaccgcatttttagcggtataccattttttgaccccgaaaacgatcaacaggagggcgataacggcacaaacaacccagcgccaaggatgccacttcttaggcggacggggattacgttgccgtttttgccggctgccactggttgggttattttgctcctcggcgttggaatcattttcctccggcgcagaattaaactggttgccgctaaatcggcttaaattggaattccgtgagtcttcactcatacaagtttcctccacaatgttaaaaatcaattactaatataataccaaatttatttggcggtttgattgaattaactaaagtttaatatttagtgtataaaaaagtagtttttgtgcttttgaagaataaaggtccattttctttactaatggaaaataagccccgttatagttcgcgtaaaaaagctaatgcattagcaatccaatcggcaatgcgagaatcttggtgacactcgtcgtaagccgtagtttcgtcagctaacgccattccgtgaggaccgtggtggtaaaggtgtagttcggtgggcacttgatgagcttgaagtgctaagaagtagtccacggcgttttttgaagaaactaactggtcgtcagtggtggcccaaatgaaagttggagcattgtcggcggttacgtgttggtcagcagcaatctcatcgggattgtcagtccactgcgccaaagtaggttggtcagggaagccatcaaatggggtaattactgggtaacctaaaatagtagcggcgggctttaaatcttctgcagataagtgggtttgtgcttgtaaccagtctgaagaccataaattgttgtaattagcgactacgtgtccgccgacggaaaagcccatcaacatgactttttggcgatcaacgtgccattgtgcggcgttttgtttagtagtggcgattgcttgcgcagtttccaacaggggagccgggaagagcggttgaacttcgtcgacaaaagagtaccgtaagatggaaacttgaaaaccaagtgacaaaaagcgtaacgcaactttttcggattgcttaaaatcaatgtgagtataagagcctcccggtacaaaaattagcgcagggttaagcgcgtcggtaaggctgggatcaacgtaggaaattaactctgcttgagattgaggatttacctggttaagtggtgttttaattatttgcataagatcgactccttttaagtagtaaaatatattcacatagattatctatagactatcttaaatctttttgagtcatacgaaaaataatttgggagaaataaatgaaatttaaactacgatactttgcaacgagtgactttgcagattatcaagtactgatgaataacgaaaaactcgcgcgactagcgggaatgcaagttttaaaaacggaattagagcagtggctagctttcaaaggaatggtaggcagcccgaatttcctagcgattgttaacgaggaaaaccggttgagcgggggaatctttatttttcagcaggcggaagaagccgtttttgaactaggatatttactggctgaagagtattggaatcaaggaattatgtcgcgggcagtccattttgcgttgaagagtttaaggaatcggcaatcagcaacggggcgaaccgtaaaagttcaggccaacgttttaacggataaccaggcctctcagcgagttttagaaaagaatggttttattcgccaaccggggatgtttgaaaatgtatccgggtatgacggccgcgtccggaaagaatatttatacgaattgaaccttaagcttgcataattaatcaagtttgctataatttgaatcacatcgaaagaagaggtcgcctcaatgatgagtaaccctggtaagatgattaagcatctgggacccagggagaaaggtaacgaggccgaaatgactgtagacttaattctgcacgatttgggacttggttgaataagccaaggactgtcgcaattacgattgcggagcgctatctacgatttgactaacgattttaaacggtctttttgtgtaagtgcgcgcaaaaaggctttttattttgttctgggataatcacagcgcctcttttaatttttaggaggttctctattatggcacagttacaaaagcaggcgagcggcaatcacgtccagcgggcgctgaagactcgtcacatctcaatgatttcactaggcggcagtatcgggaccggcctgttcgtcgctagtggtttagcaatttctcaagccggcccgggtggtgccctactagcatacgtcgggatgggaattatggtgtacttcttgatgactagtttaggcgaaatggcgacctacatgccagtttccggatcatttgctacgtacgcttctaagtacgtggatcccgcctttgggtttgcaatggggtggaactactggttcaactgggcgattacggtcgccgtggatattagtacgattgcgctgattatgaaattctggttacctaacgttccgggatggatctggagtttgattgcgttagcactggtagtcttgattaatgcgttaaccgttaaagcgttcggggaaaccgagtactggttagccttaattaaggtagttaccgtctttgttttcttggcagtcggaactcttaccattttcgggattatgggtggccacgcaacttacttagaaaactttgtataccggaaggcaccgtttgttgggggaattccagcaatcttaagcgtcttcgtcgttgccggattttctttccaaggaaccgagttaatcgggattacggctggggaatcagaaactccggaaagcagcgttcctaaggcaattaaccaagttttctggcggattttattattctacattttggcgattttcgtaattgcctgtctcttaccgtatactagtccagatttgctaggaacttcggcaagcgacgtttcaattagtccgtttacccttgtattccggcgggctggtttagcaggtgcagcgggggtaatgaacgccattatccttacatcggtgctttcttcggctaactcggggatgtacgcatcttcacggatgttgttctcgttggcaaagcaaggttatgcagcgaagatctttggccggacgaccaagcgggggattccttacgtggcgctaatcggaaccaccgtggtcgggttattaacctttattaccagcattatgggaactgagatttacgcttggttagttgcggctagcgggttgaccggttttatcgcttggatggggattgccgtatctcattggcggttccggcgcgcattcgtcaagcaaaaccatgatttaagcgaattgaagtaccgggcaaagtggttcccatttggaccgttgtttgccttcgtgttaagtattgtggttatcttaggacaggacattaattccttaatcaaccttaactggcaggcgattgggattacctacatgtcggttccactatttatagtgctttttgcatattacaaaattaagtataagactaaattaattccattagaggagatcgacttaagtcggccgaatatcacgaaaaagtgattttttcaagatgttgttttgcgttcgtttggtggtacaatatgtggtgctattaaatgaaaaaggggtatcttaaatgattgctttatcaggtccaatcggcgccggcaagacgtcactgacggaattattaacccagcattggggtagcgatgcttattatgaatcggtagatgacaacaaaattttgccgctcttctataaggatccaaaacgttacgcatttttattacagatttattttctaaacaaacggctagatagcatcaagcaagctaacgacggatttagaagcgtaatggatcgctcaatttatgaggattcgttactcttccatctaaacgctgatttaggacgggcgaccgaaaccgaagtcaagatttacgattcgttgttgagcaacatgatgcaagaattaccacggctttcatacaagaaaaacccggaccttttgattcatattgatatttcgtttgataccatgttaaaacggattaaaaaacgcggtcgttcatacgaacagattgaaaacgacccgtccttatacgattactataaggaattaaatcggcgttacgtatcgtggtttgaaaactacgaccaaagtgccaagattagaattgatggcgataagtatgactttgtggaagaccctagcgcacgtcaacaagttatccaattagttgaagaaaagatttcgcaaatttaattgcggaagttgcatcttttttgtataatacggttaacaattaaatagttcagttgttaacaaggcgttttaagtaggtttttagagaggtccggatggtggaaagggctaaccgaaactccggcgctgattaaacaaatgggtaatgccattcggtgattccgttaccatcatgaaagtgcgccagtaatggtgaacttgggtggtaccgcgaaaagagcctcttcgtcccaattgggagggaggctctttttattttgattttagtaaggaggaatttgcatgttagatttaaagatgattcgtaaccatactgatgaagttaaggaaaagttagctacccgtggggttcaaccagaaacgattgaccagctattggcaaaggataaccaacgccgggagttgattgtaaagagcgaaagcttaaagaaagttcgaaatgacgtttcggaccaaatttcccagatgaaacgtaaccacgaagatgctaacgaaccaattcaaaaaatgcggaaagttagccaagaaattaaagaactcgatgagcaattagaaaaggttgctgcggaagtagaagaccaagcggcccacttgcctaacttaccacatcctgacgtaccggtaagcttaaccgaagaaggcagcgttgaattacgtaaatttggcacccctcggaagtttgatttcaagcccaaagcccattgggaaattggcgaagatttgggaattttagactttgaacgggctgctaaggttgctggtagtcggtttgtttactacgttggcgatggtgcgcgtctcgaacgtgcagtttacaatttcttcttagatcaaaacgtggcggccggatttaccgaagaaatcacgccttacatggttaatgatgcgtcgatgtttggaactggccaatttcctaagtttaaggaaacgcacgctggttatgaaattaaagatgaaccactaaccttaattccgacggcggaagtgccattagttaacttctaccgggatgaaattttggatgaagaccagttgccaattaacgtgactgcactttcaccagcctttcgttcggaagcagggagcgctggacgggacacccgtggtttaatccggatgcaccaattcaataaggtagaaatggttaagattacaaagccagaagattcttggcaagaattagaaaaccttacgcgccacgcggaaaccctcttacaaaagctaggattgccataccacgtgattacgttgacgaccggggacatgagttttacggctgcaatgactcacgacttagaagtatggattccagcgcaaaacaagtaccgcgaaatttcaagttgctcgaacaccactgatttccaagcgcgtcgtgctcacatccggtaccgcgatgaaaatggtaagttacagtatgtccacacgttaaatggttcgggacttgctgttggccggacggtagccgcaattttggaaaactaccaaaatgaagatggtacggttaccgttccagacgttttggtaccatatatgcaaggaaccaaggtaattggtaaaaattaataatttaggttaaaaataacggcagggcttggtgttttatccaagatgcttataaataaggattaatcttttattgcagaaggttaatccttatttttttaaccattttacgtgccgatgtagtgggcaatcattcgtagcaaacggtttaatttagagtttcgaaaaaaagtttaaaaaagtgattgacaactaatggtttaatccgtattatatataaatgtgttcacgaggtttatggaggattagctcagttgggagagcatctgccttacaagcaggaggtcacaggttcgagccctgtatcctccattgagattattctcagtggttttaaatgttacatgcgggcgtggcggaattggcagacgcgcaagatttaggttcttgtatcgaaaggtgtgggggttcgaatcccttcgcccgcatagggattaagccgacttagctcagttggcagagcatctgtcttgtaaacagagggtcggaggttcgaatcctctagtcggcattttgcggaagtagttcagtggtagaacatcaccttgccatggtgggggtcgcgggttcgaatcccgtcttccgctttaacttaataattatgcacccatagcgcaactggatagagtgtctgactacgaatcagaaggttgcaggttcgactcctgctgggtgcatccttcaaacgtcaatcgttggattggcgtttttttgtgtcctgaaccaacgtgacgggagattcggattattttgaaattgcctaattggcaaagtgcgccattgtgaaaaacagcgattgcgaaaattaagttttgtgatataatttttaagtgttggaaggctcttgcgagtattcttaacgattgattatttgcacccatagcgcaactggatagagtgtctgactacgaatcagaaggttgtaggttcgagtcctactgggtgcattgattaagcattggtcagcatggctgagtagtgctttttcatttttaagcttctaatacgaagttgctcgggaaatagctcagcttggtagagcaccacgttcgggacgtgggggtcgcaggttcaaatcctgttttcccgatttatcgattaagcgaataaagtgactttttgaccatattggtcactatccaagtcaccgaaataaaaagcgttttgcaagaattttaagttcttggaaaatgctttttatttttgagcctgagcggaagtttccagtacctgttgcggaattagttagggtaagtgattacttatgagatgaatttatctagggaaaaaatccgaaacagggtgcttaaaatccacgatattcgttagcgcagacaaaaatgttgacataaagtaagtatagttgtaaattaatatttgtaatcggttacatcattataaataaaaaatcgaggtaagtttagatgagtgaaaagactgtaccagcaagtgtcgcaatgttaagagtccttcaggcttgggatattaaacgtgtttttggatatccaggtggttcgtttaattcaacgatgaacgctttagacctagaaaaggatcgaattcaatatgtgcaagttcgccatgaacaagttggcgccctcgctgccgctgctgaagcaaagctaaccggcaagattggagttgcctttggttcagcaggtcccggtgcggttaacatgttgaatggtttatatgacgctaaggaagaccatacccccgtgttggcactagttgggcaagtacctcatagcaacatgaattacgatttcttccaggaatttcctgaagttccaatgttccaggacgtggccgtttatgaccgctgcgtaatgaccccggaaagtcttccatacgtggttgataaggctattagggcagcgtacaaaaaccgcggaccagcggtagtggtaattcctaatgatttcggttacgttcaaattccggacgtaaattatgcttcgactgcgttattagaaaagcaaactcctaaacaaacaccaactgacgaagaagtagatcaattcttgaagatggttcgcgaagctaagcgaccagtcttccacgtgggttccggaattaaggaccatcaagatctcttgaagaaagttgctgaaaaactacaaatccccgtaaccattactggtctagcaaaaggtaaggttgacgatgattgggaaggtaacttgggtaccactaaccgggcagcatccaaggcagctgacgaagcctttgcaactgctgacttagtgattgcgctcggcgctgacttcccgtttgccaacctagtttaccggactcatgattttaagtttgttcaaattgacaacgacgaatctcaattcggacgtcatcacttcttggacttaggaatctgggcggattcgggcaagttcttggaaaaagttttggaacggtccgaagctgttgaaaatcggccattctaccaagcaacggttgccgacatgcaagattggaaagcatacttgaataagctaatgaagaaggcggacggtccgctatcttacgaacaaatttatcgggaaattaaccggattgcggataaagatgcggtttttggcattgatactggtgacaacatcatcaactccttccgcttccttgacttgaagggcgataagcagtggacgatttctgcattatttgccacgatgggctacggaattccggctgcaatcgcagcaaaacttgcatatccagaccggcaagtgtttagtatttcaggagatggggcagcttcaatggtaattcacgacttgttgaccgaagtgaaataccacttgccaattattaacatcatcacttctaaccaaacccttaactttattaagtcagaacaagatgatattcaaatgaatcattctggaattgatcttgaagacgctgactatgccaaaattgcggaagcgatgggtgcaaagggaattacaattagaaccttagatgaattaccagcggcctttgataaggcgttagaatatcaaaaagctggcgaaccagtagtaattgatgctaaaattaccgaccaacggggattgcctgttgaagaattggaattcgacaatcaagcggcaaacttcaccgaaaagatctcggctgcttatcaagcaacccacggtgaaaagtcagtcagtgatttctttaacgactacgatggagccgaattgaagccgctaacggattactttgctaagtttggtgtggaaaaatagtttactaagcttgcattttaaactcatttaaaataagatagaaaccttcagaaaagaagtggaagcggaatttaattaaattctaaacgccacttctttttgtgctcttagcccaagaacggaaaaataccgtgaaaccggttaataccgataattttgaacaatatcttttacaattgccgaccagtttcgtataataatagtcaatattagtcaaagtagggagaggtggtcgttatgcaaggacagaatatttcggatataatcgagcgatacttgaaagaaattttagctgattcggaggaagttgagattcggcgttctgaaattgcggatcagtttgacgtagtaccatcccaaattaactacgtaattaaaacccggtttaccatccaaaacggttatttagttgaaagtaagcgcggcggcggtggctatatccggattgaaaaagttaaattgctagatgatattgacgtattagattcgttgatccgggtgattggcgattcaattaatgaacgagacgcaatttctattttaagcagtttatatgaagatgcggttttaagtaagcgggaagctaatctactagctgcaacaattgccaagagtaccttaaacattggcgatcggaaactagaagaccagattcgcgcaaaaatcattatcggagttttaaatcaccttcgatatgagtaacgagtttagagaaagacaggtggacaatggaaaatttatttactcctagcgcacgcaacgtgttaattattgctcaagagcaagccaaacggtttaaacatcccgcggtgggaacggagcatttactattagcactaacgattgaaaacaacggcgttgcccacagtgtgttagaacaatttaatgtcaccgaaattgatgtaattgaagaaattgagcagtttacgggttacggcaacttacgcttaaccaaaaatgattacttgccatattcgccaaaggctaaagagattttagcgaatgcgggagaccaagcgcggcaattaaaagctgctaagattggtacagaacacattctattagcgctgattcaagatgagaccatcttatcttcgcgagttctgttagcgttggatactgacgttgcggacgtccgtaaagtaacgttacgtaagctgggggttaacccagcaacccaaagtcggcgtgctaagcaacgggcgacgacaacgaagggaactccaacgttggattcggttgcccgggatttaactgccatggcggaagccggcaaaattgacccaatgatcgggcgagaaaacgaactccgacgggttattcaaattttgagtcggcgaaccaagaacaacccggtattgattggggaacctggagttggtaaaacggcgattgcggaaggtctcgcacaacgaatcattgccgatgacgtgcctgaagatatgaaaaacaaacgcttgatgatgcttgaaatgggtgcgttggttgcgggaaccaagtaccggggcgaatttgaagaccgcttgaagaaggttatcgaagaaattcgccaagatggcaaagttatcctatttattgacgaattgcacaccttaatcggggctggtggtgcggaaggtgccattgatgcttccaacatcttgaaaccggcgttagcgcgtggagaactacaaaccatcggggcgacaaccctaaatgaatatcaaaaatatattgaagcggatgcagctttagaacgacggtttgccaaggtagaagttgatgaacctacccaagcagaagcagtccaaattttacaaggaatccggccaaaatatgaagaacaccataaagttcggattactgatgaagcaattcaacaggcggtaaacttgtcggctcgttacatttccgatcggttccttcctgataaggcgattgatttaattgacgaagcagccgctaagattcgaatcgacgctgccgaaaagcagagtaaacgagaaactgacgaagataagttagctcggttgaaggcagataaggaagccgccattgaccgccaagactttgaaaccgcggccgaaattcggaaaaaggaaatgaaactgcggaaaaaggtcgaacgagcagctgcccggcaagcagaagcggaacagccagttgaatataagttacaagaaactggtgaagacgttgctcaaattgtttccgattggaccggggtgccggttactcaaatgaagcaatctgaatcggaacggttggttaacttagaaaaaatcttgcacgaacacgtaattgggcaagacgaggccgtttcttcagtagctcgggcaatccgacgggcccggtccggattgaaaaatcctaaacgaccaattggttcatttatgtttcttggcccaactggggtagggaagacggagctggcgaagacccttgctaacgtaatgtttggttcagaagataacatgatccggattgacatgtcggaatacatggaacgttttagcaccagccggttagtaggttcggctcctggatacgttggctatgacgaaggtggccaactgaccgaacaagttcggcgcaagccatactcggtagtcttatttgatgaagtcgaaaaggcccatccggacgtgtttaatttattgctccaagtcttcgatgatggattcttgaccgattcgaagggtcgccgggtcgactttagaaatacgatcatcattatgacttctaatttaggggcgacggcgttgcgggatgaaaaatcagtcggttttggagcccaaaacatggctgatgattaccaagcaatggctgcaaaggttaaggaagtcttgaagcaaagtttccgaccagaattcttaaaccggattgacgaaacgattgtcttccattccttaaccaagccagagttgcatcaaattgtaaaattgatgtcgaaggatattattcggcggatgagtgcgcaaggaattaacatgaagttcactccagccgcaattgacgtggtagccgaagccgggtttgatcctgaatacggtgctcgcccaattcgtcgagcacttcaaacacaagtagaagatcaacttagtgaaatgttgcttgctgggcaagttaaggtaggcgacgacgtgacgatcggggctcgcaaccacaaagtcacttttaaagtgaaggatgctaaaccggtaagcagtacaagtaaataaatgatttgacaaagcttttaaaagagcatagaatataatctgtatgttaaagctgggttaaatgaaacagtgcgatctattgtccgcagtgttttagaaaaaaagcaaaaatagtttcttgaattaggaactgtttttggtttttttttgctaaaaaacaggtgctggatcaatttgtaatcaaattgtaacatttaacttgtcttagaaattggagaggtgaataacttggcaggacatttagttaagtatggtaaacatcgtacgcgccggagctatgcacgaattaaagaagtactcgatttaccaaacttaatcgagattcaaacggattcgtaccaatggttcttagacgaaggtcttcgggaaatgttcaacgacattatgccgattgaagattttgccggtaaattgtcacttgagttcgttgactatcagttgttagaaccaaagtataccgttgatgaagctcgtgaacatgaagcaaactactctgcgccattgcacgttacgttgcggttgactaaccatgaaacgggtgaaatcaagtctcaagacgtcttctttggtgacttcccattaatgacggaacaaggaactttcattattaatggtgctgaacgggttattgtttcacaattggttcgttcaccaggggtttattacaacttagacgttgacaaaaataatcgtaatatttggggcgcaacggtaattcctaaccggggtgcttggttagaatatgaaactgatgctaaggaagtttcttacgttcgtatcgaccggactcggaagattccaatgacggaattagttcgggcacttggttttggttctgacgaagaaatcattgatatctttggtgggtcagacagtttagactttacccttgataaagatgtgcataaaaatccggaagattcgcgagttgcggaatccttaaaagatatttatgaacgtcttcgtcctggtgaacctaaaactgcggacagttcgcggagcttattgactgcgcgcttctttgatccaaagcgttacgatatggcaccagttggtcgttacaaggttaacaagaagttaagcttgaagacccgcttgctaggtcaaaccctcgctgaaacccttgctgacccagatacaggggaagtattggctcaaaagggtgacgttgttgacaaagacgtaatgaagaagttggcaccttaccttgatcgtcaagatttcaagatggttacttaccaaccttctgatgaagcggtagttccagaaccaatgacgattcaagtaattaagattcaagaccctaacgatcctgaacgtgaattaaagatgatcggtaatgggaacattgatttgaagctcaagcacattactcctgccgatattattgcttcaattaactacttcttcctattacaacaaggaattggtagcactgatgatattgatcacttgggtaaccgtcggattcgttcagttggtgaattgttacaaaaccaattccgaattggtttagctcggatggaacgggttgttcgggaacggatgtcaatccaagatgccgaaaccgttacgccacaacaattaatcaatattcgtccagtagtggcagcaactaaagaattctttggttcttcacaattgtcacagttcatggatcaaaccaacccgcttggcgaattgtcgcataagcgtcgtctttcagctcttggaccaggtggtttaactcgtgaccgtgctggatacgaagtccgggacgttcactatactcactatggtcggatgtgcccaattgaaactcccgaaggtcctaatatcggattgatcaataacttggcttcttacggaaagattaaccgttacggctttattgaaacaccataccgccgggtttcttggaaagatcacaaggtaaccgaccggatcgattacttgactgctgacgaagaagaccaattcgttatcgcccaagcgaactcgccgttaaatgacgatggttccttcgtggatgacgtagttatagctcgtcatgaaagtgacaacattgaaaccagcattgaaaacgtcgactacatggacgtttcacctaagcaagtagttgcggttgcgacggcatgtattcctttcttggaaaacgatgactctaaccgtgctttgatgggtgcgaacatgcagcgtcaggcggttcctttgcttgaccctcacgcaccattgattggtactggtattgaatataaagctgcacacgactcaggagttgctttgttatgtcaacatcctggggttgttgaatacgttgatgctcgtgaaattcgggttcgtcgtgatgacggtgcactagacacttacaaattgatgaagttccgtcgttctaacggcggtaagaactacaaccaacgtccaattgttcgggttaacgacaaggttgacgccgacgatgtattggctgatggtccatcaatggaattaggtgaattagcgctcggtcaaaacccattgattgccttcatgacgtggcaaggttataacttcgaagatgcgattgcgattaacgaacgcttggttcgtgacgacgtttatacttctattcatattgaagaatatgaatcagaagcgcgtgacacgaagttaggaccggaagaaatgacccgtgaaattccaaacgttggtgaagatgcattgcgtaaccttgaccaagacggaattgtgcggattggtgctgaagtccaagatggcgacattttagttggtaaagttactcctaaaggggtgacagaactttccgctgaagaacggttgttacacgctatctttggtgaaaaggctcgtgaagttcgcgatacatcgctccgtgtgccacatggtggcggcggtatcgtccaagacgtgaagatcttcactcgggaaaatggtgatgaactttctcctggcgttaacatgatggttcgagtttacattgctcaaaaacgtaagcttcaagttggggataagatggccggccgtcatggtaacaagggtaccgtttcggtagttattccagaagaagatatgccatacatgccagatggtactccaatcgacattatgcttagtccaatgggtgtgccttcccgtatgaatatcggacaagttttggaattgcatttgggaatggcagctcggaacctaggaattcacatgactacacctgtttttgatggtgctcgtgacgaagacatttgggaagccgttgccgaagctggtatggactccgatgcgaagtctgtattgtacgatggccgaacaggtgaaccgtttgaacaacgggttgcggttggtgtcatgcactacatgaagctcgcccacatggttgacgataagattcatgctcgttctattggaccttactcattagttacgcaacaaccacttggtggtaaagcacaatttggtggacagcgttttggtgaaatggaagtttgggcccttgaagcttatggtgcagcttacacattgcaagaaatcttaacttacaagtctgatgatattgtgggacgggttaagacttatgaagcaatcgtgaagggtgaatcaattcctcgtcctggcgtaccggaatcattccgcgtgttggttaaggaattgcaagctttaggactagacatgaaggttcttggagaagataagcaagaggttgaacttcgtgatatggacgaagatgatgatgaagttgtcaacgttgatgctctaagcaagtatgccgaaaagcaaaaggcggctaatgctaacgaagctgactcgtcaacaacggaatctactcctgtggaaactgaaaacaaccaaaattaatttttataaaagaaagaggaggtcagtccgttgatcgatgttaataaattcgaaagtatgcaaatcggtttagcttcgcctgataagatccggatgtggtcgtatggggaagttaagaaaccagaaaccatcaactatcgaactttaaaaccagaaaaagatgggttattcgacgaacgcatttttggaccgactaaggattacgaatgtgcttgtggaaagtacaaacggattcgttataagggaattgtttgtgatcgttgtggtgttgaagttactaagtcaaaagttcgtcgcgaacggatgggacatattgaacttgcagccccagtaactcacatctggtactttaaaggtattccaagtcggatgggcttagtacttgacatgagccctcgttcattggaagaaattatttactttgcttcttacgtagttgttgatcctggtgatactccacttgaaaagaagcaattgttaactgaacgtgaataccgggctaagttagacgaatacggaaatcgtttcgtagctaagattggtggggaagctatccaagccttgctacaaagcgtggacctagaaaaagaagctaacttactaaaagaagaattgaaggaagcctctggccaaaaacggacgcgtgccgtacgtcgtttggacattattgaagccttcatcaagtctggtaaccatccggattggatggtaatggatgctatcccagttattccgccagatcttcgtccaatggttcaattggatggtggccgttttgctacttccgacttgaacgatttgtatcggcgggtaattaaccggaataaccggttgaaacgcttattagacttgaacgcaccgggaattatcgtgcaaaacgaaaaacggatgctccaagaagcggtagatgcgttgatcgataatggtcggcgtggtcgtccggttgctggtcctggtaaccgtccgttgaagtcactctctcacatgctgaaaggtaagcaaggacgttttcgtcaaaacttacttggtaagcgggttgactactccggacgttcggttattgatgttggtccatcattaaagatgaaccaaatgggtctcccagttccaatggcaatggaattattcaagccattcattatgaaggaattggttagccggaacttagcttctaacattaagaacgctaagcggaaaatcgatcgtaaagacgaagaagtttatgacgttttagaagatgttattaaggaacatcccgtgctattgaaccgggcccctactttgcatcgacttggtattcaagcctttgaaccagtccttgttagtggtaaggcaatgcggcttcacccattagcttgtgaagcttataacgccgactttgatggggaccaaatggcgatccacgttccgctatctaacgaagctcaagcagaagcacggctcttaatgcttgctgctcatcacattttggcacctaaggatggtaagccagtggttacgccttctcaagatatggttatcggtaactactggttaaccatggaacgtgctgaaagcgttggggaaggaatgatctttaacgacctcgacgaagttaaacttgctttgcaaaatggttacgtatcaattcacacccgaattggggtgcgggcaagttcaatgcctgaaaagccatttaccgatcaacaacggcaacaaattttgatcaccacggctggtaagatgttgttcaacgacattttgccaaaggattttgtttatctaaacgcgccaactaacgaaaacttagttaacggtacgccggatgaatacttccttgaagctggtgaagatattcatgaacaattgaaccaacgtccgctactttcaccattcaagtctgggttcttgagtgatgtaattgcggaagtttacaagcaatacaaagttaccgaaacttccttgctccttgaccggatgaaggaccttggtttctaccgttccacactttctggattaaccgtggggattgcggatattaccaacttgccggacaagcctacgattattgctgcagcgcataagaaggtcgcaacggttactaaacaattccgtcgtggtttgattacggatgacgaacgttatgaacgggttattggaatttggaacgatgctaaggatgaaattcaacaacggttgatggataccttcgatccacaaaatccaatcttcatgatgtcggattctggtgctcgtggtaacatctctaactttacgcagcttgccggaatgcgtggtttgatggctgcgcctaacggtaagatcatggaattgccaatcttgtcaaacttccgtgaaggacttaatgttttggaaatgtttatttctactcacggtgctcgtaaaggaatgactgatacggccttgaagaccgctaactcaggttacttgactcgtcgtttggttgacgttgcccaagacgttatcgttcgtgaaaaggattgtggtactgaccgcggtctattgatcactgcgattgcagaaggtaacgaaatgattgaaccactttacgaccggatccttggtcgttacaccatgaagtcagttatcaatccagaaactggcaaggtgatcgtgggtcaaaacgaaatgatcgacgaacgtagtgcacaagaaatcattgatgctggtatccaagaagtaactatccgttccgcatttacatgtaacacggctcacggggtttgtgaaaagtgttacggccggaacatggctactggggaccgggttgaagttggtgaagcagttggtacagttgctgctcaatcaatcggtgaaccaggtactcagcttactatgcgtaacttccatactggtggggttgctggtaacgccgatattacccaaggtcttccacgtatccaagaaattgtggaagctcgtaatcctaagggacctgctgaaatttccgaagttactggggtggttgaatccattgaagaagatcctgccgaaggtactaaggaagttaccgttaagggtgaaacagatacccggacgtatagcttaccaatcactgcccgcatgaaggtagctgaaggtgactacatccaccgtggtgcaccacttaacgaaggttctatcgatccgaagaagcttatcaaggttcgtgacgtactttctactgaaaactacttgctcagtgaaatccaaaaggtttaccgtatgcaaggtattgaaatcagtgacaagcacgttgaaatcatgattcgtcaaatgcttcggaaagtacgggttatggatccaggtgacacagatattcttccaggaacgttgatggacatcgacgacttcaagaaggataactacaagaccttgatcgctggtggaatcccggcaacatctcgtccagtaattcttggtattactaaggctgctttggaaactaatagtttcttatccgcggcttccttccaagaaactacccgagtattgacggacgcagctattcgcggtaagaacgatccgttggttggtttgaaggaaaatgttattatcggtaagattattcctgccggtactggaatgacagactaccgtcaaattaaaccagaagtggttggcggcaatactgaacaaccacaaacgttaagcgacgttgaaaaagaaatgaacgaaacaattgaaaattaattgtgaattttaaaagggtgttccaagttattttgacttggaacacccttttttgttaggaaatggaatttagttttagaagttgctgcgcagactttgggcgagctggtcgaagcggtcgtaaaaggcgtctgcattaacttgggtaacaaaggtgacgggacgacccgtcggatccggatacgtttttccggctgaaatccccttagaaatcacttttacattaagcggcttgctagaaactagttcaggatacttgctaatcaaggtggtgagcacgtcccaaaggtagtaagttgaattagcttcgaaagagtgcactaacgagtaaccctgaccaatcaagtcgagagcggggtactgccgttgttttgcccaacgttgacgtagcgcagtggtgagggggacttggttagtactgtctaggctgacgatagtaatcggtaaatcgctatcgaatacagtttgcactgcctcggggtcccaaaaagcgttccattcagcagagccgtcgtgtgcaggttcggctacgtttccgattccgttcattgaaccccccatccagaatagccgatcaattttggcggtgatggtgggatcaactgctaaagcacgtgctaaatcagtcaatggaccagtcattacgagggtgactggcacagatgattgctgaagtttttggaccatgtcgaggtgcgccggctgtttagctaaccgagtttggggattaccctcattgaggtgttcatttaaaatcgggaaatcatcgaacgaaaatgcacttagccgccattccttaggaaattggttgaccggccgggagtcggattgggccacttcgagttggctaggcgaaccgaatagatcgataattttgcgcgatgccgaaacggcgggttcgacgtaagagtcggcgcccacggcactaaccccgacaatttccgtatctggaaaagcgagtaataaaatcaacgaaactaaatcatcaacgttgccgtcgtgattgaaataaattttttgcatgatggtaaccccctaaatttgattatggttatcttagcataattagttgtggagctgaatggttaatataggtaaggactaaccaattggcggcaaaaaggcaggggacgaaggcaaccattcgttgtttgctaaccattatgcgcactaacgcaattaggcaggctaagcaaataatttctgaagttacggacgtcccgaataggagggcgagaaaaaccattacttcaaggtcgccttgacccattttttgaaaaaaacgctggttttcaaaattatttaatagtaaaacggttaataccacgagtactgcaaatttcacaccgctaaaggattggtaagtttcaaatagcgcgggaaatagcaaaatttgggagtggatttgtctagtggcgtaatcttctacactaagaaaacttagaatcaacagagttagaagtgtaaagggttcgccagtagttagttgtatggttaaccaaaagctgatcccgctaatgacttcgagacccagcattttgaggggaatctggtttccgcaaaaaagacagcgccccttgctaaagcagtagctaaaaatagggaataaacaaaagtagggtaggggagttaaacaataatcacaatgggaagcaggaaaagtaatggagcctccggttaagcgacgttgataagtagccattaaaaaagatccccatgaacaaccaaagtaaaaaattaaaaaatgatagaatagtaacattgcatttgcctcctcagtaaccgtaactaaatataaaactacgaaactaacggagcgttttttttattgattaacttgcattcaataaaattgcgtgatattctatttaaggtgctttttgtggacaggttctctgcgcaaatgcagacatgctgactggaaacgttagccctggtacccgtcctggccatctttttttatagcaaaaaaagaaccgcctggatatgtgtacttaaaaatacttaaattatttttcaattatttggaaggagaaacatcgatgcctacaattaaccaattggttcgtaagggtcgtcgttctcaaagctcgaagtcaaaggctccagctttgaactacggctacaacagcatgaagaagtctcaagttaataatccagctcctcaaaaacgtggagttgcaacacgtgtcggtactatgacacctaagaagcctaactcagctttgcgtaagtatgctcgtgttcgtttatctaacttgatcgaagttacagcatacattcctggtattggtcacaaccttcaagaacatagtgttgtcttgatccgtggtggacgtgtaaaggatttacctggtgttcgttaccatgttatccgtggtgcacttgatacagcaggggttactgatcgtaaacaaagccgttctaaatacggtacaaagaagcctaagaagtaaggaggtcgtgtataaatgccaagaaaaggtccagcaccaaaacgcgaagtattaccagatccaatttataactcaaagcttgttacacgcttaatcaaccgtttaatgttagatggtaagcgtggaaaagcttcaaagattctatacaaagctttcgatattatcgaaaaggaaacgggttctcaaccaactgaagtattcgaagaagcaatgaacaacatcatgcctgtccttgaagttaaggctcgtcgtgttggtggttctaactaccaagttccgatcgaagtacgtccagaccgtcgtacaacccttggtttacgttggttagttaactacgctcgtctccgtggtgaacacacaatgtcagaacgtcttgcacgtgaaatcatggatgctgctaacaacactggtgcatctgttaagaaacgtgaagatacacataagatggctgaagctaaccgtgcctttgcacattatcgttggtaaaattcagtcgttgcaattacttgttgcaaccattgatgactattatatggatgcatatagtagtcattttttctaacaggctattaattgatttcattggaaggagaaactttaaataatggctaacaaacgtgagtttcctttagaaaagactcgtaacatcggtatcatggctcacattgatgctggtaagactaccacaaccgaacgaatcttgtactatacaggtaaaatccacaaaatcggtgaaacccatgatggtgcttcacaaatggactggatggaacaagaacaagaacgtgggatcacaatcacatccgctgctacaactgcagcatggaaagaccaccggattaacatcattgataccccaggacacgtggacttcactatcgaagttgaacgttctctccgggtacttgatggtgcggtagccgttcttgatgcacaagcaggggttgaaccacaaactgaaacagtttggcgtcaagcttctgattacaacgttccccggatcgtttttgctaacaagatggataagatcggtgctaacttcgacttctccgtacaatcattacgtgaccgtcttcaagctaatgctttaccaatccaaatgccaatcggtgccgaagatgactttgaaggggttattgacttagttgaaatgaaggccgacttgtatgatgaagacgaattaggtactgaatgggataccgttgaaattcctgaccaatacaaggaagaagctgaaaaacgtcgtggcgaaatgcttgaaattttagctgacgttgacgaaaacatcatggaaaaataccttggcggtgaagaaatttctactgatgaaatcaaagctgctatccgtaagggtactttgtcacttgaattgttcccagtacttgctggttcagcattcaagaacaagggtgttcaaatgatgttagacgctgttgtggattacttaccatctccattggatgttaagccatacggtgctacagatcctgatactggtgaagaagttcaattgattgccggcgacgacaagccatttgctgctttggcatttaaggttgctactgacccatttgttggtcgtttgacatttatccgtgtttaccaaggtactttggaatctggttcatacgtattaaatgctacaaagaacaagcgtgaacgggttggtcgtttgctacaaatgcactctaaccaacgtcaagaaatcccagaagtattctctggtgatatcgctgccgcaatcggtttgaagaatactactactggtgattctttaactgatccagatcatccattacacttggaatcaatgcaattcccagaaccagttatcgaagttgccgttgaaccaaaatcaaaggctgaccaagataagatggacgttgctttacaaaaacttgctgaagaagatccttcattccgtgctgaaactaacccagaaactggggaaacagttatcgccggaatgggtgaacttcacttggatatcatcgttgaccggatgaagcgtgaatttaacgttgaagctaagattggtgctccacaagtttcttaccgtgaagcatttacaaaacaaacttctgctcaaggtaagtttgttcgtcaatctggtggtaaaggtcaatatggtgatgtttggatcgaattcacacctaacgaagaaggtaaaggattcgaattcgaagacgctatcgttggtggtgtagttcctcgtgaatacattccatcagttgaacaaggtttgaaggaagctatgaataacggtgttcttgctggttatccattagttgacttgaaggctaagttatacgatggtagttaccacgaagtcgattctagtgaagctgccttcaaggttgctgcttcaatcgctttacgggaagctgctaagacggctgcaccagttatcttagaaccagttatgaaggttgaaatccgtgttccagaagaatacatgggtgatatcatgggtcaagtaactgctcgtcgtggtcgtgttgaaggtatggaagcaattgctggtgctgaagaaatccacgcatttgttccactttcagaaatgtttggctatgcaactacgcttcgttctgcatcacaaggtcgtggtacatttacaatgacctttgatcactacgaaccagttccaaagtcaatccaagaagaaattatcaagaaaaatggcggaaaagctgaataatttctaaaatcgaagttctcttttttaacgtttaaagcgttagggaagggaacttctttttttgcaaaaaaatcgctaaatgcccttgccacgggggcgtttttcatgtatcataatcaagtaccgtgtaaaaacgagggggcatgctgccctccccacggtggtgtataagcagagcgttgatgtgaaaggttgcgacacacccggccgctttgccacagggtgtggcggtaattttcacggagcaagtcttatttttaaaatagacgagggaggtaacacaatggcaaaacaaaaaattcgtattcgccttaaggcttacgaacatcgtattttagatcaatctgctgacaagattgttgaaacagcaaaacgcactggtgcaacaatttcgggtccaatcccattgccaacagaacgcacagtttacactgttttgagttctccacataaattcaagaaggctcgtgaacagtttgaaatgcgcacacataagcgtttgattgatatcgttaaccctacaccaaagacagttgattctttgatgaagcttgacttgccaagcggtgtagatatcgaaatcaaattataattttaaagcacaaacggaggtgtactaatgaccacaaaaggaatcttaggtaagaaggtcggaatgacacaggttttcactgaagctggtgaattaatcccagttacagtaatcgatactactcctaacgttgtattgcaacttaagactgttgaaaacgacggttatgcagcagctcaattaggttttgacgacaagcgtcaagtattgagtaacaaacctgaacaaggccacgtagcaaaagcaaatacaaatcctaagcgcttcattcacgaaatcagagatgttgagcttggggaagatgttaaagtcggagacaagatcgcagcagacatctttgaagcaggtgacttcgtcgatgtaactggtactactaagggacatggtttccaaggtgttatcaaaaaagacggtcaacgtcgtggtccgatggcgcacggttctcgttaccaccgtcgtcctggttcattgggagcaattattaaccgcgtgttcccaggtaaaaagttgccaggtcgcatgggtaacaagacagttacaattcaaaatctagaaatcgttaaggcagatacagaaaacaacgtacttttggttaagggtaacgtacctggcgctaagaagtcatacgtagttgttaagagtactgtaaaaaacacatctaaataagagaggaggaccaataaatggctaacgtatcattattcaaacaagacggaactcaaaacggaaccgttgaattaaatgccgacatcttcggtattgaacccaacaacgatgtggtctttgaagccgtagttatgcaacgtgcatctatgcgccaaggaacacacgcagtaaagaatcgtagtgctgtacgtggtggtggtaagaaaccatggcgtcaaaagggtactggacgtgctcgtcaaggttcaattcgttcaccacaatggcgtggcggaggaattgtcttcggacctactcctcgttcatacgcatacagcattccaaagaaaatgcgtcgcttagcattgaagtcagtactttcacaaaaggtattggatgaaagcttggttgttgttgatgaatttaagttcgaaactccaaagacaaaggactttgctcaatcattaagcaaacttaatgttgaaaagaaagctctattagttcttgaagaagataacgaaagtgctgtattggctgctcgtaatttatctaacgtaaaaattgttgaaccaactggtatcaacgttttagatattatgaatagcgacaaacttgtcattacacaaaaggctctttctcaagtagaggaggctctagcataatggaatcacgtgatattattttacgcccagttgttaccgaagcatccatggcgttgattgacgacaagcgttacacgtttgacgtagatcctcgtgctacaaagactcaagttaagaaagctatcgaagagatctttgatgttaaggtaatcaaggttaacattatgaatgttaaaggtaagttgaagcgccaaggccgttacgctggttacacaaagaagcgtcgtaaggcaatcgttcaactttcagaagattcaaaagaaatccaattatttggtgaagaataaaaaataggagggaaacaacgtggggattaagaaatttaagccaacaacgaatgctcgtcgtggcatgacacaattggactacgctgaaatcacaaagaagcgtccagaaaagtcattgttggaatctcaaagccattcagctggtcgtaacaactacggtcggatgacggttcgccatcgtggtggtggtaacaagcgtcaataccggatcatcgactttaagcggattaaagacgatgtgccagcaacagttaaggcaatcgaatatgatccaaaccgttcagctaacattgcattgcttgtttacgctgatggtgttaaatcatacatcattgctcctaaaggtttaaaagttggcgaccaagttcaatctggacctgaagccgacattaaagtaggtaacgcgctaccacttgcaaacattcctgttggtacagttatccacaatatcgaattaaaaccaggtaagggtggacaacttgttcgttctgctggtacatcagctcaattacttggtaaagaaggcaagtatgcacttgttcgtcttgcatcttcagaagttcgcatgattcttgctacaaaccgtgccacaattggtgctgtaggtaacgaagaacacgaactaatcaacgttggtaaagctggtcgtaaccgttacgctggtcaacgtccacacgttcgtggttctgtaatgaaccctaacgatcatccacatggtggtggtgaaggtaaggcacctatcggacgtccatctccactttctccatggggtaagaaaacaattggtaagaagactcgtaacaaacataacaagtcaaacaaatttatcgttcgtggtcgtaaacgcggtcgcttaggtaatatctagaacagttttcgaaggaggtcaaattaatgggtcgtagtttaaaaaagggaccattcgctgatgaacatcttttgaagaagatcgatgcacaaaaagatcaagaaaagaaatcagttatcaagacatggtcacgtcgttcaacaatttttccaagtttcatcggttacacaatcgctgtatacgatggtagaaaacatgttccagtttatatccaagatgatatggttggtcataagcttggcgaatttgttccaactcgcacattccgtggtcacggtggcgacgacaaaaagacatctggaaagtaaggaggatgaatcatggctgaacaagtaacatctgcacaggcaactgcaaagactgttcggattgccgctcgtaaggttcgtctcgtagtcgatcttatcagaggtaaaagtgtcgctgaagcttttgcaattcttaaatttacaccgcgcagtgcttcacctatcgtagaaaaggtattgaagtctgcagtggcgaatgctgaaaataactttgatttggatcgtgaagatttggtaattagcaaagtctttgttaacgaaggaccaacgttgaaacgtttccgtccacgtgctaaaggctcggcatcaccaatcaacaaacggacaagtcatattacagttgtagtatcagaaaaataggagggataacgcgtgggtcaaaaagtaaatcctaatggattccgtgttggtgtcattcgtgattggcaagcaaaatggtatgctgataaagactttgctaagttccttggcgaagacatcaagattcgtgaatttatcgcaaagcaactcactgatgcttccgtatctactgttgaaattgaacgtgctgcaaatcgtgttaacatttcaattcacactgcaaaaccaggtatggttatcggtaaaggtggatcagaagttgaaaagttgcgtaaacaactaaatgaattaactggcaaacgtgttcacatcaacatcgttgaaatcaagaaacctgatcttgaagcaaaacttgttggtgaaaacattgctgctcaactagaaggacgggttgcattccgtcgtgctatgaaacaagctatgcaacgctcaatgcgtgccggcgctaaaggtattaagacacaagttgcaggtcgtctaaacggagccgacatgtcacgtgtagaacactattccgaaggtaaggttcctcttcacacattacgtgctgatgtggattacgcttgggttgaagctcgtactacatacggtcaacttggtgttaagacatgggtttaccgtggtgaaattttacctgaagcaaaggaagctaataacaactctaaagaacaaggagggaaataagcatgttagtacctaagagagtaaaacatcgtcgcgaacatcgtggacggatgcgtggtgccgctaaaggcggtaagacagttacttttggtgaattcggcttacaagcattgacttcatcatggattactaaccgccaaattgaagctgctcgtatcgcaatgacgcgttacatgaagcgtggcggtaaagtttggattaagattttccctcataaatcatacacatctaaaggtgtgggtgttcgtatgggtaatggtaaaggtactccagaaggctgggttgcaccagtaaaacgcgaaaaggttatgtttgaagttgcaggtgttcctgaagaagttgcccgcgaagctcttcgcttggcagctatgaaacttcctgttaagacaaagattatcgcacgcgaggaagtaggtggcgaatcagatgaaggctaaagaaattaatgaattaaccactgacgaaatgatcaacaaggaaaaagagtacaaggacgagttattcaacctacgtttccaattggcaactggccaacttgaaaacactgctcgccttaaagctgttcgcaagaacattgcgcggatcaaaactgctctacgtcaacaagaattaaacaagtaaaagaatacgaagggaggacttagtcaatgagtgaagaacgtaacgcacgaaaggtttaccaaggacgcgtagtttctgacaagatggataagactatcacagtccaaatcgatacttacaagacacatccagtttacggtaaacgtgtaaagtactcaaagaaatataaggcacatgacgaaaataacgctgcaaagaagggcgatatcgtaacaatcatggaaacaagacctttgtctgcaacaaagagattccgtttgcttgatatcgttgaaaaagcagttattatctagctcatgtttcgtattctgatacaaaattgaagggaggacactaactgtgatccaacaagagagtcgtttgaaagttgctgacaattctggagcacgtgaactgttggttattaaggtattgggtggttcccgtgttaaatttggttacattggtgacgttgtggttgctacggttaaacaagcaacaccaggtggcgttgtcaaaaaaggtgacgttgtcaaagcggttgttgttcgtacaaaacaaggcgcacatcgtgctgatggttcatacatcaaatttgacgaaaatgctgcagtattaattaaagatgataagagtccacaaggaacccgtatctttggcccagttgcacgtgaattacgtgataaggactacatgaagattgtttctttggctcctgaagtattgtaatcgaccatcataacgaaggaggtgcgccattaaatgttcgtaaaagttggcgacaaagttcgcgtaatcagcggaaaagacaagggcaaggaaggtaccatcaaacaaacacttgctaaaaagaaccgtgttgttgttgaaggcattaacatgattaaaaaacatcaaaagcctaacaatgcaaatcctcaaggtggaattcttgatattgaagcaccaatcgatgtttcaaacgtaatgcttatcgatccatcaactaatgaaccaactcgggttggcttcaaggttgttgatggtaaaaaagttcgtgtttctaaaaaaactggcgaaagtatcgacaagtaatctaaacggagggaggaaaataaattcatggcaaatcgtttaaaagaaaagttcgttaacgaaattacacctgatctagttaagaaatttgactacacatcagttatgcaagtaccaaagattgaaaaaatcgttttgaatatgggtgttggtgatgcagttgctaactcaaagaaccttgatgaagctgttgctgaattagcacttatttcaggacaaaagccacttgttacaaaggctaaaaagtcaattgctggattccgtcttcgtgaaggtatgtcaattggtgccaaagttacacttcgtggtgaaagaatgtatgacttcttagacaagttgatcaacgtttcattacctcgagttcgtgatttccacggtgttagccgtactgcctttgatggccgcggtaactacacattaggtgttcgcgaacaattgattttcccagaaatcgattttgataatgttaaccgtgttcgtggtttggatatcgtaatcgttacgacagcaaacactgacgaagaatcacgtgaattattggcagaatttggaatgccatttgaaaagtaagcgaagggagcaaacaaattggctaaaaaatcattagttgtaaagagtgaacgtcctgctaagttctcaactcaagcatatactcgttgcgaacgttgtggccgtccacactctgtataccgtaaattccatttatgccgtatttgccttcgtgaattagctcatgaaggacaaattcctggtatgaagaaagctagttggtaaaaagaaatcagagttaaaggagggtaatactgaatgtctatgacagatccgattgcagactttcttactcgtattcgtaatgcgaacatggttcgtcacgaatctttagaagtacctgcatcaaaaattaagaaggatattgctgaaattcttaagaacgaaggctttatcaaagatgttgaatatattgacgatgacaaacaaggcatcattcgtgtattcctaaaatatggaaagaacaacgaacgagttatctctggtttgaagcgtatttcaaaacctggattacgttcatacgtaaaagctgatgaagttccgaaggtgttgaatggtttgggtatcgcaatcatctcaacttctgaaggtgtaatcacagataaagaagcacgcgctaagaaaatcggtggagaagtattagcttacatctggtaattttttagataaggaggtgccgttcaatgagccgtatcggtagaaaaccagttgaagttccagctggtgttgaaattaaacaagacggaaacgtcgttactgttaaaggacctaagggtgaattaacacgcacaatgagtgcggatattaaaatgaacgttgaaggaaatgttgttacatttgatcgtccaagcgatgataacaagatgcgcgcattacatggtactacacgcgctaactttaacaacatggttgaaggagtaaccaacggtttcgaaaagaaactcgaattagtcggtgttggttaccgtgctcaacttaaaggtaagaagcttgttttgaatctaggttactcaaacccagttgaaatggaagctcctgaagaccttaaggtagaagtacctgacaacacacacattaatatcagtggaattagcaagcaacgtgttggtgattttgccgctgaaatccgtgccgtacgttcaccagaaccttacaaaggtaaaggggttcgctacgttggtgaatacgttcgccgcaaggaaggtaagacaggtaagtaatctagcagcttgatatagttagctgataatttaaaaatatgaggtgaaaattttgatttcaaaaccagataagaataagaaacgtcaacgtcgtcacgcacgtattcgttcaaaaatctctggtactgcagagtgcccacgcttaaatgtatatcgttctaacaaaaacatctacgctcaagtaattgatgacgtagcgggtgtaacgctagttagtgcctcaacattagatagcgaagtttcaggtggctcaaagactgaagctgctgcacaagttggtgctttggttgccaagagagctgttgaaaagaaaatcgaaaatgtcgtttttgatcgtggtggatacctttaccatggtcgtgtgcaagctttagctgaagctgctcgcgaaaacggacttaaattttaaggataggagggaaatacgtacatgtctaagtttatcgatccagaaaaattggaattggaagaccgcgtagttgccatcaaccgggttacaaaggttgttaaaggtggacgtcgtcttcgttttgctgctttagtcgttgttggtgacaagaacggtcatgttggttttggtactggtaaagctcaagaagttccagaagcaatccgtaaagcagttgaaactgcacgtaagagtttgatcgaagttccaatcgttggaacaactctccctcacgaagccatcggtgtttacggtggtggacggattctgatgaagccagctgctgaaggttctggagttactgctggtggtgctgttcgtgccgttatggaattagccggtgttgatgatgttacaagtaagcgtttgggttcaaacactccagttaacgttatccgtgctactttcgaaggccttaagagcatgcgtaatgcagaagaagttgctgccctacgtggggtttcagtcgatcatttagctgaataaggaggatattctgatgtcacaattaaaagttacattaattaaaagtgccgcacatcgcctccctaaacaaagaaaaattgttaaggaattaggtcttggccgggttaacagttcggttgtcctacctaacaatgaggcaactcgtggagcaattttccacattgcacacttaatcgaagtcgaagaagtaaaataatattgtaagattggaggtttccttgcatgaagttgaatgaattaaagcctagcgaaggctcacggactagccgcaagcggatcggccgtggtgattcaagcggtaacggtaagacagctggtcgtggtcaaaagggacaaaaggcacgtggaaaagttcgtttaggttttgaaggtggccaaatgcctctttaccgtcggattccaaaacgtggttttacaaacattaaccgcaaagaatacgcaattgttaatcttgatgcacttaacgtatttgacgaaggtgctgaaattacacctgaagcattgcttaaggctggtatcatcaagaaacaacttagcggtgttaaaattctcggtaatggtgaagtttcaaagaaattcactgttaaagctcaaaaattctctgcgagtgctgtaaaggcaatcgaagctgctggtggtaagaccgaggtgatttaatgttttcaaccgtcatcaatgctttaaaagtgaaggatatccgtcataagatattcttcacacttggtattttgattgtatttcggttaggatcatacatcaccgttccgggagttaatgcgcatgctttgcaaagcatttcctcttcgggattagttggaattcttaatacctttagtggtggcggattgacaaactactccattttcgcaatgggagtttctccatacattacggcgcaaattattgttcaattgttacaaatggacattgttccaaaatttgtggaatggagtaagcaaggtgaggttggccgtcggaagcttaatcaagcaacccggtggttaacaatcgtccttgcttttgcgcaatcaatcggaatcactgctggttttaactacttgagtcaaatgaatttagttgaaacaccaaatgtacacaccttcttaaccatcgggttgattttaactgcgggaacgatgttaacaacttggttaggagatatgattacagaacggggtattggtcaaggggtttcaatgatcatctttgcagggatcattgcccggacaccaactggaattcaacaaatttatactgaacagtttgttaatacgccgaaaagtcagtggggccaaagcttcttgtatgttggattaattttacttgctgttttagccattgttattttcgtaacttgggtacaacaagcaagccgtaaaattccaatccaatatacacgccgggcttcgggtgcatctgacagcagttacttaccattaaaagttaacgttgcgggagttattccggtaatttttgctagttcgtttatttcaactccccagaccatcttaatggcgtttgcttcatctcattcagaagatgattggtacaatatcttgaccaacgtgtttaatatgcaaacgacggatggcgcaatcttatacaccgtgttaatcgtcttgttcacgttcttctacgcatttgttcaggttaatcccgaaaaattagcggagaatttacaaaagcagggcagttacatcccaggtgtttggcctgggaagaaaacgcaaagctacgtttcgagtcttttgattcggttgagcgtagtcggagcacttttcttaggtttagttgcgttaattccgttacttgcatctaacatctttggtttggatgaatcaattggattaggtgggacaagcttactaatcgtggtaggagttgcaattcagttgtttgaccaacttgaaggtctaatgatgaaacgagaatacatcgggtttattcgtaactaattcgtcgtttagcaatgaaggagaattactaatgactaaattaaacctcgttttgatgggcttgcctggtgctggtaaaggtacccaagctcaaaagattattgaggattttaaaattccgcacatctccaccggtgacattttccgtgaagcaatgaaaaatgaaaccaagatggggattgaagctaaaaagttcatcgataagggtgaactagttcccgatagtgtaactaacgggattgtcgaagatcgtctagcaatggacgatgtcaatgatggttttatgcttgatggtttccctcgaaacctcgaacaagctaaggcgttagacgaaatgacatctcgcttaaataaaccattgacggcagtgatcaacattcatgttgaacctgaagtcttggttgaaagactatctggcagatttatttgtaagaattgtggagctacttatcataagctctacaatccaccaaaggttgaaggaacttgtgatgtttgcggacatcatgaattctatcaacgtgaggacgacaagccagaaacggtaaaaaatcgaattgccgttaacacaaaacttaacgcgcctttgattgattactatgaagaaaagcatctcctttacaatattaatggcgatcaggatatcaacgatgtttattctgaagtcaaaaaagtattagaggctctctaatttcgtgcttgttggtactatagataacgttcattgtttgcaaatagttttttcgtatggtaagctgattcaggtttagcttcggaatacatattttgaagctttttgttggtttttactgttagaaaagttaattaggaggcacaaatttagtggctaaagataatgtcattgaaattgagggcaaagtcaaagaaactatgcctaatgcgatgtttaaagtagagcttgaaaatggtcatgaaattcttgcccacgtttcgggtaagattcggatgcattacatcaagattctacctggagatcgggttacggttgagatgtcgccgtacgatcttaccaagggtcgcattacctatcgtttcaaataagttttattcgtttaggaggatttattcatgaaggtacgtccatcagttaagccaatgtgtgaacattgcaagatcattaaacgtaaaggacgcgttatggtaatttgctcagcaaatcctaagcacaaacagcgtcaaggaaaataattattatacttggaggtgaaatttaatggcccgtattgcaggtgttgatttaccacgtgacaagcgtattgtcatcggtttgacatatatttacggtattggtaacactaccgctcaaaaaatcttaaaggacgcagatgtttctgaagatgttcgcgttcgcgatttaacagcagatcaagaagacaagattcgtgcagaagtagacaagtatcttgttgaaggtgatcttcgtcgtacagttagtctcaatatcaaacgtctccaagaaatcggttcataccgtggtatgcgtcatcgtcgtggtttgccagttcgtggacaacacacgaagaataacgctcggacacgtaaaggtaagaaagtttctatcgcaggtagaaaaaaataattaaaggaggctaaacatttatggcaacgaaaagaaatactcgtaagcgtcgagtaaaaaagaatattgaatctggagtagctcatatccattcaacattcaacaatactctggttatgattacagaccctcaaggtaacgcagttgcttggtcatctgctggtgcacttggtttcaagggtagtcgtaagtcgactccatttgctgctcaaatggcttcagaagctgctgcaaaggctgctatggaacatggtatgaagaatgttgaagttgctgttaagggacctggttctggtcgtgaagctgcaattcgtgctctccaagcaactgggcttgaagtaagcgcaattcgtgatgttacaccagttcctcataacggatctcgtcctccaaagcgccgtcgtgtatagagttcggttctgtttgagggcaaactttataatgcattcaaagtcgaaatgcagactgcgttttgaaaggggtaaaaattagaatgatcgaatttgagaagccaaaaattcataaaattgacgaaaatgacaattatggccgatttgttattgaacccttagaacggggatatggtacaacgcttggtaattcacttcgtcgaatcctattatcgtcgcttccaggagcagcgattaccagtgttcaaattgataacgtgttacacgaattctccactattgaaggtgttgtagaagacgttacacaaattattttgaacctaaagaaggtttccttaaagattgaatctgatgacgaaaagacgttagatatcaacgtagtgggacctgccaacgttactgctggtgatattatgggagacggtgatgttacggttctcaatccagattcaccaatttgtactgttgcagaaggaacgacattccatgccgttttaactgctgatactggccgtggatatacttctgcggacgaaaacaaggctcgaaaggcagatatgccaattggcgtattgccaatcgattctatttataccccaattgaacgtgttaattatcaagttgaaaaaactcgtgttggtcaacgagatgactacgataaacttacgctcgatatttggactgatggttcgatcactcctagtgaggcaacaagtttatctgctaaaattttaactgaacaccttgctatctttgtaaaccttaatgaccaggctaaagagactgaaattatggtggaaaaagaagaaactcacaaggaaaaaatgcttgaaatgacaatcgaagagttagatctttcggttcgctcatacaattgcttaaaacgagcaggtattaacagtgttcaagaattaactgatcgcactgaggctcaaatgatgaaagttcgtaaccttggacgtaaatcacttgttgaaatccaagaaaaactgaatgctttgggcttgagtttccgttcagaagactaatcataaggagggttcccatagatgagttatcgtaaattaggtcgtacaagctcccaacgtaaagcgttgcttcgcgatcttacaacagaattaattgttaatgaaaagatcgttacaactgaagcccgtgctaaggaagtacgttctacaactgaaaaaatgattacattgggtaagcgtggcgacttacatgcccgtcgtcaagctgcagcatttgttcgtaacgtcgttgctgatgttacagaagatggtgaagatgttaaagtttcttcagcacttcaaaaattatttgctgaattggctccacgttatgctgatcgtaatggtggatatactcgtatctacaaaacgatgccacgccgcggagacggtgccccaatggttgtcttagaattagttgactaattctaagcaattataagaataacaaaatctatcactaagatattggtagggtgttacgatgctggagaaatccgagtctagcccacggcgagtttacggacttgctacctttatcttcagtgattttttttgtatacaatgataaaattagttccatattgtatcgggagagtaggactgtggaaaacattattgaagtaaagcatcttacgtataaatacgctaataatggtgagaaaaaggcactggatgatgtctcggtcgctattcaaaagggaacctggacggcaattgttggacataacgggagcggtaaaagcaccttagcacgcacaattgacggattgatgacgtttcgggaaggcacggtcacggtagccggaattccccttagtgaggatacggtatgggacgtcagaaaaaagattggcatgatttttcagaatccagacaatcagtttgttggcgccacggtggaagatgacgtggcctttggactggaaaacttaggaattcctactgcggagatgcaccagattgttgagcgggtgcttactcaggtgcgaatgagtgactttaagtcccggcaacccgaccagttgtctggtgggcaaaaacaacgggtggcgattgccggagtgttggcgactaaaccggaaattatgattttggatgaggccaccagcatgcttgatccacagggacgcacggaaattattcaactaatcaaccaagtgcaccaacaacaagatttaaccgttctttcaattacccatgacgttagcgaagcaatgctagccgatcaggtaattgtattaaatgacggtaaagtagtcactacgggtacccctcaagcggtttttgcggacaaccagcttttagagcagactggactagaaaagccctttagcggtcagctctatgacgaactcgtggcccatggattcaacgtgccactagcattaaaaatgaacgaaactaaattggaggaatgggtatgtcaattaagttcaaatcagtaagctacgtttaccaagcccatactccttttgaaaacctgacgttaaaggacgttgatttaacaattcctgatggctcgtataccgcaatcattggccacactggtagtggaaagtcgacgctgattcagcacgttaatggtctattgaagcccacgacggggacggtcgaggttgataatcaagtaattgatgcaaccacaaaaaataaggcactggtggctctaaggcagcacgtgggaattgtttttcaatttcctgaaagtcagttatttgcggaaaccgtgttggacgacgttaaatttggtccgctaaattttggtttaagtgacgcggaagcgactcaacgagctcagcaggcgcttgcaaaggtacacatgcccgaaaacacttggcaaaaatcaccttttgaattatcgggtgggcaaatgcgtcgggtggcaattgccggaattttagcaaccaacccggcaatcttaattttggacgagcccacggcaggtctggatccgcagggacggaccgaaatgatggagctttttgcggaattacatgatcaagagcacttaacaatcctgttagtgacccatcagatggatgacgttgccaactatgccgatcaggttgtggtaatggatgacggacaaattattaaggtgggaagtccccgagccgttttcagcgctccagagtggttattagaacaccagttaggattgccccaggttacggagtttgcccaacggttaatgcaacgtggattccacttcgacccagttccgctgcaaatgggcgaactaattgaacagcttaagcagaacgggggccgtgcacgtgaataagattttatttgggcggtacattcctggtcattcttttatccaccgaatggacccgcgcgctaagctaattttaagtttggtatacattgtcgccgtatttcttgccaatagttgggcagcttacctagcaagctttgttttagcaatggtgattatcgcagcgtcggcaattggtccacgtttcttttgggacggggtaaagccgttaattggggtcattttactgacgatgattatccaggtgttctttggtgtcgggggtcacgtctactggcattggggaattctgtctataaccagcaacggacttttaaatgccgtgtacattgcgataaggtttattttaattattctagtttctaccgtacttacactgacaacttctcccttggaaatttcgggagcgattgaagccatctttatgccgctaaagaaagtgcactttccggtctatgaaatggcgttaatgctgtcgattgctttgcgttttgtgccaacgttaatcgacgagacggaaaagattttaaatgcacaacggtcccggggggctgattttagctctgggtcgattttggtgcgtttaaagaagcttgtggccatcctcattccactgtttgaaagtgcctttagtcgcgctgaggagctcgctacggcgatggaatcgcgcggttatcaaggtggagaagggcgcagtaagtatcgggttttaaattatacaaaaaatgatattatcgggacggtaacgatgctgcttgcagcagtagtgattatcgcccttagaagatgaggttgacatgcgttataagattacaatggcttacgatgggactaactttgcgggctttcaagcgcagcctaaccaacgaacggttgagggagtgttaaaacgcgcggtgaataaaattgcgaagaacccccaacctgaaattccaattttcggttctggtcgaacggacgccggagtccacgcctttggtcaggtagtgcattttgatttgccaattgaaatgacggccaataacatgttgcacgcgttgaacagtattttaccgttagatacgcaggtaaaaaaggtggagatcgtggacgaagactttcacgcacgctttaccacccatggcaaacgatatcagtaccggatggcgttaggggagtttgttgacccgtttaaacgcaattacaccggacattggaaatttccgattagcattgaattgattcaacaagcaattaaagatttagagggtacccacgacttttctagttttgtggcttcgggaagcacggccaaaaatcacgtgcggaccatttacgaggccaaggcctggaaggatgaagcccaaaacgaaattatttttgaattttacggcaatggctttttatataacatggtgcgaatcatggtggccgttttagttgaaatcggtagtaaacggcggccagtggatgatatcccgcggcttttggcggtcaaggatcgcaaccaagcccggggaactgccccagcaagcgggttatatttaaaagaagtcgattattagatttttgattgactttaaccgggactgtcaatataatggaagttggtattgtttacctccacaaaataagccccggaaacttattatagttgagttaaacaaaacagaaattggaggaaattcaagtgcgtacaacatatatggctaaaccaggtgaagtagaacgtaaatggtatgtcgttgatgcgaccaatgttcctttgggacgtctttcaacagttgttgcatctattttacgtggtaagaacaaaccaacatacactcctaatgtggatactggtgacttcgttatcgttattaatgcagacaaggttaagttgactggtcacaaggcgacagacaagatctactaccaccacacattgcatccaggtggtttgaagatgaagactgcaggtgaaatgcgtgaaaagactcctgaacgcttgattgaaacatcagttaagggaatgcttccacacaactcactaggtcgtaagcttggtttgaagttgcatgtttatgctggtacagatcataagcatcaagctcaaaacccagaaaagcttgacatcacgaacttaatttaaggaggaaatgaattttggctgaagcacaatatcgcggcactggccgtcgtaaaaactccgttgctcgtgtacgtcttgtaccgggaaccggtaaaatcactgtaaacgatcgtccaatcgaagaatacattccatttgcaaacttacgtcaagtagttatccaaccattcggcgtaactgaaacaaacggcaactatgacgttattgctaacgttaatggtggtggattctccggacaagctggcgcaatccgtcatggtattgctcgtgctcttttggatgttgatcctgatttccgtgcacctttgaagaaggctggtttacttacacgtgaccctcgtatgaaggaacgtaagaagtacggtcttaagaaagctcgtaaggctgcacaattctcaaaacgttaatcgttactatacacaacgattacaacaccttccagaaatggagggtgtttttttgtgcaaaaaatccgttaacggtatttagagttacaaataccattaacggatgtgaagaatatcagtttagaaaagatgttttctggatatatttaaggaatcgctggtattcggtatttcacttaaatatcgaatgattacttttagttgtattacaattagtaaaaaagcggttgtaattagctagaaacgttagcaattgatttagtaatagttactaaatttagtaagaaccagttcgtgttactgtttgatattcgggtatatgactagcagcgttgaattgatcgcgcggtccaccttctaaagagcctatttcggcgtggatcctaacttggttatttttctctaacgttaaagtaaagtagttaatacctctggcgccagagaaggccgaaataactaacctttgtggtttgttgctaacaagttgggaatcttcgcctaggcaatctttgtaaatactatgttgtagaatttgcattccttcttcaaaggttaacggggagacttctggagtttttgaggatgatgaagtatttttctgatttgaagaagagcggacaatgctattaaatttgttggttaaatcatcatctggagctttttcaaagtgtactaaaccatcgggagcgccttggttttgctcagtgtaatatacaatcggagagttgtcttgaattgcaaataaataaatacaaccgccaactgttgccccgccgttagtattttcataaatagctacgacatttacgtcatatttattagcaccatcttctgaccatccggcagaaagctttcgattgttaaaagtagttttattatcagcgaaatcattggggtaatgcaaacctgtatacgtagtatttctctttggggtacattgtacataatttttctgcgtagtttgattccaagaggccataaagtctgctaattgtacatctttgtttttatcccaattcgttgtacttttagtagatttggaattgttggaaagagctttatttatatgctttcggttttgttttgaaactatctttgtagcagattttcttgtattgttgcggttaacattttggttattatttgaattacagcctgttaaaactaacgggataatagttaacagagctatagaaattaattttttcatgatggaatcctcttattttgaaatgtggttaaataacttcatccgatgctgttttaatttacgcatccttactaagatatctaataagcaaaaatctcaggcaagagatgtagaaatctgtcgcctgagattaaatgtaaactttttgatatatggcttaattagttaggaatttaaccatgcttacgtttgtaggtggatacaagtcctaaactagataaaaatattccgactatgccgagcaaggtcatcttttgtccttgtttttgttcatcagtttgtggtaaacgaggttgaacattcgacttatagtcagtatcatccaagcttgttgaaggttgattggtggaagcaaccgctgcgttgttttgcgaattaggtgctccagcttggttgacagtaccattagcagcattgctagattcttggttggagtcattagcattatctgaatcagcgtcgctgcgactagtgtcggaaccttgattttgattatcaccagcagcattgctgttagcatcattattgccggcattgctatctgaattatggctgtggtcagcatcctgatggccggaattgttatttgtggcggaatcattattagaaccattttcatcagaattaccattatcagcatcgtgatgaccatcggagtcattattacccgaatcattgtcagaatcatggctgctatcagagccattgccgtctgagctgtgatcatcagaaccattattatcggagttattatccgagttgccattgtcagcattgttcttggcatcagctagagcttgttcatcttgagccaatttagcttctaggtccttgagttggtctttaagctgttgaattttagcttcggaatcagctaaagcctgttgatgatcggcaagtgctgctttagcatcagccaaagcttgatacaattgggccgctttggcttggtcggcttttaaggtttttaatgccgcttgataagctttaagctgatcggcgtatttggctgcagcgttagccaaagcttgttttgcatcagcaagtttagtttgggcaacttgcaacttagcttgggcgtccttcaaagcttggctagcattggttaagctattgttagcagctttgacactgctttgcgcgttattgtagttgtaattagcttgttggtaagctttggtagcttggctaagctgattcaacgcattttggtagtcgttaacggcttgagtataagcggggttagtttccgtggcatcatagccgtggttggcgtaggcagtgtaaaggccgttgtttaaggctttttcagcttcgccgtcagtgctagtccgggcaacccagaagtcaaagaggtaggctgtggtatcaaagccagtgccatagacatcgccatagttttgtaagttgaagctcatgtaaacttgatcagcttcgtcagagctgccatacgtatggcttaagaagttatcacggtgaccccagtcccagttaccatcggcgaagcacattcccgtgagttgttgaagcaattcaacttttagttggagcatggtaacgtcattagaaccgaggatactatcaaagaggttttcgccaccactgataacgtcgtattgattgccaccagccacgcggctaatggcgtcatcaaggtcgctagagttagtatcggtatgcacaccggcttcggtttggtctttgacccgcaagtcgatgacggcttgaccgagttgttggacggtatccgacattaaaattggttttaagtcgtgttgcgcccggaagctattaattaaagcaagggcgtattcagcaagttctttttgttgcgcggcggttaaatgcgtaccagctttgataactgctgaggtgtcgttagcgccgacgtacttataccaaggatcggaagaagcgtaatgatcttggttcttttcagcatcggttaagccatctggttcaactaggtcagttggtaaatcggcatcgctgttgatttcgcttggcttagtttgtgaacccggcttaacgggatgcggatcgtgatgaacgttggtggttgctggcgtattgtcagccttatctttagcagcatccgctttgttttgagcgtcagctttagctttggcggccgcgtcccggtctttagcagcttgattagcgtctttttgcgcttgatcagcatcatgctgcgcttgattcttattagcggtagcttggtcaacgtcgttttgcgcttggtcagcattttgttgcgcatctttagccgcgttttgggcatcagtatattcatctggttttaaatcgtcggcagtttgctgatcgtttttgacttggtcattagcagtgtcagcagctttttgcgcgttatcaacgtcttgttgcttcccggcagtctgctcggccaattcgtcatgatgattttgttcattaacagtgtcagcttgatttttagcaatgtcgtcttggtcttggtcgacagctgcttgagcatcgtcgacggcgttagtgttctgcggagtaacagcacggttagaatcaccaacgttagccgagacttgcgtactgctaatttcatcagcatgaacgttggtgtttaatacggcagtactccccaaaactgttaatgcaattccagaaacaagccaaaacttacctgccttaaacattttaaagtggaccttgtctgcacgtttttccataaaaacctcctagaattttttaaaatatagtaaagtaccattttctgaacttcggaaacctttgacacgtttaagttggctattatgcaattttgggagcgtccctgaatgactgcgttttcaaaatttatttagctaaacaaaattatgtattgtgattcaggaaattagcaattttatttacaaatgcttactcaaccgaatcccgtgtaaagattcctctcaaggaattataacctttatatatatactcatcaacgtaacttagcagtaaatatgcaaatgtactgaaacttatacatcactatagataaggacctctttgaagctaaattaattttgttgatgaatataaatgagattatcatttaataaatagcgttttatcccgggatgctaaccgacggaagacttttaaaaagccgttcgtgaagaattaaaatatcgggtaaatcatttgaatggtaaaattgataaaaataacgaggagggaaaacgtatgaaaattaacattcaccgttcggcaaataatcggttattggctggagttttaggaggactatcggagcattacggatggaatgccagtcacgtccgaataatttacctacttgtaagcttcacacctatttttccaggaatcatcgtgtacttgattttatggttattaatggaaagccccgtggattactcaaaaaaacgtaaaataattaattagttgtagaaagaaagataataaaattggtctggttgtttttggtggataaaatcaaccagactttttatttggattcttactgcaatttacgcttaagtgtgttattctggaaccgaaaaagggtggttggaggtgaccagagatgtaaaattaaatagtagtaaatgctgaaataacaatgttttttagcgatgttgatagaatgttctaccctggatttaaaatgataacttagtgaagtaaggtacgtttgaataagtaaattgtaccggtttaatgatagtcgttaagttgttcacaaaagaagggaatggaatctcatgaaaattggtatacctaaagaaattaaagcgcaggagcaacggatcggagcagcaccaatcacggtcgctaatttaatccaggctggacacgaagtaattattgaatcaggtgcaggagtaggctcaggttatcctgacgaagcctacgaagagtttggagcaaaaatcggctcggtagaagatgtatgggactgtgagatgatcattaaggttaaagagcctttaccagaagaatacaaatacttccgtcccgggctcattatttacacctacttccaccttgcagcagatcggcgactaactgaggaattgctaaagagcagggttaccagtattgcttatgaaacgatggtcggacctaatggcgagttaccgctgctctttccaatgagtgaaattgcgggaaggatggcagttcaagtcggagcgcacttcctggaacggccacaatctggcaagggattattgttatccggagttactggggttcctcgaggaaggttaccatcatcggcgctggaacggttggatttaacgctactaaaacagcagtcggtctgggagcacaagtcacggttttagacatcaatgctcaacgactagcagaaatcgacaacttatttagtggcaaagttcaaacgttgatttctaattcttacaacattgcaaaagcagttaaggaagccgacctcgtaattggagcggtgttaattccgggcgctttggcaccgaagctagttactaccgcaatggttgatagtatggaaccaggttccgtagtggtggatattccaattgatcaaggtgggatttttgaaactagcgtcaaagcaacaacgcttaaagacccgatttacatctcccacgacgtaatccactacacggtatctaacgtaccgggtgcggtaccaaagacttccacggacgcattaactagtgcgacggtacgctacgcaataatgattgctaaccaaggtgtagaagatgcggccaatgaccggaccattttgacgggaatcaacacgttcaatggacaattgacttctaaagcggttgcggatagtttaaatatcgaatacacaccgttcatgagttagttgatgatcctgatgaaaaataagattaatttagaccttattttcaaaaatgctgctaaaagcgaagaggaacgaactttaagtttgtttgatttatcaattttggggatcggtgcgattattggaaccggaattttggttctgactggaattgtggcggccaccactgccggaccagcggtagttttttcctttttgattgctgcattggcgagtggcttaattgggttatgctactctgaattggcaacggcaatccctaattctggtagcgcttacgtatatgcctgggttaccattggacagctagttggttttttagcgggttggactctattgggcgtgtacatgactacggcagcgacggttgccaacggatggaccggctacgttcgctcgttcttacacgaattaggagttaacctaccgcaccaactgttggtagcgccgtccatgggcggttggatgaatttaccagcctttttgatgatccttttaatcaccttcgttttaacgaaggggacgggagaaagtaagtggatcaataacgcgctggttttagtgaagttgacgatcattttgctatttatcgtggtgagcgtccccaatgtcaagacgggtaattggagttcctttaacccgtatggaattaaggggattgtcacgggggcctcgaccgttttcttcacgtttcttggatttgacgcgctagcaacttcggctgaagatgctaaaaatgtgcgccataacctcccgcgcgcgattgtcatctcgttagtggtaaccacttcactttacattgtggttagcattgtaatgaccggagtggtggcttatccacacctaaacgtttcggaagcaatggcgtatgttttattgagcaaggggcatgatttagcggcgcaagtggtttccgcaggagctattttggggattatggcggtagtttacgcgtttatttatgctaactccaacgtcatgaaggcgatgagccggggcgggttcttaccccaaaactgggcaaagctaaaccccaaaacgcaaagtcctaacttagcattgtggattagtggatgttttgcggtgttgctagccggctttttcgatttacgaaatctagcgttgattgctaacgtgggctcgttatcggtatttttcttaatttccttaatcgtgattttattacgtcggcagtatccggatttgccacgaccttttagaatcccgtttgggaacgtaatcccaatagctgcaatgttaatttgcgcgcttttattggctaatattactttttcggcatgggagttttatttaggatggctcgtggtaggatttgccctgtacgaactatattctaaaaaccacattattgaacggaccgatacctgattgatcagatgataacgttgatcaatcataggaatgaaggagcagctgagaaaaactaaaaaatcctttttagggatagaaatttttagggagaatcattttggcgttttgactttatatagaactaaaacgtaggtcaaaagtcagtttacccccaatcgatcattgtgccaaattcaggtataatggtcgattttcagttaagagtcaaaaactatccgacttttaatcactccctttttttcttgaccaatacgaacatttgttcgataatggtgatgaataagttagtttaaaggtggcaattagcagatggattatcgaaaggaaccccggggcgtgttttttctgattgataataaatccttttacgccagcgtggaagcagttcagcggggacttaacccactagaggcggtgatggtggtaatgtcggaacaagctaatactaacgggggattgattttggcaacttcaccaatggctaagcagatgtttaatttgcatgcaaacgtctcccgacaacgggacttacccaatacgaaccagctttgggtggtcccgccgcgaatgaatttgtacatacagaaaaacttacaaattaacaatatttttcggcaatttgtcgctgatgaagatttgctgccatattcaattgatgaatcaattttagacgtcacccattcttggcaattatttgggcaaactccacgagaagttgcccaaaaaatccaacgcaccgttcgtgagcaactggggctctacactacgattggaataggggataacccggtgcaagcaaagttagcgcttgatctttacgcgaaaaaaagtcccgcgctaattggcgagattcattatgaaagcgtggcccaaaaaatttggccaattactaacttaactgaagtttggggaatcggtaaacgcactgaacggcggttgaatcggttagggatcaatacaatggaagaacttgctcacgccaatccctttaagttaaaagaagcgttgggaattatcggctggcaactttacgcaaccgcgtgggggattgaccgtagtaaattacaacagccgatccagcctaaggatagtagtgtgggaaattcgcaggttttaccgcgcgattattgtcaacagttagaaattgagacggtaatcaaggaaattggagaacaggtagcagcccggttacgccatcgccaaaagcagacccggtgcatctcattagggattggtttttcctacgcggcaagcgttgaggatggacggggcggctttcacgtggcccaaaaaattacgcctactaacgaaaactttgcgcttacgcatgtcctgattcagctttttcgagaaaattggcaaggcgaagcggtgcgaaatattgccgtttatgcaagtaaattagctcccgcaattggccagcaactagatttatttcacccagctacccagcagattaagcattacgatatcgaaaaagccgtggacaaaattcgccaacagtatggttttaaagcgctagtatatgcacgaagtaaaactccgggggctacggcgattaaccgcgccggcttggtaggaggccataatggcggaaacgcgtacgaatagtttaattacggttctttaggagaaattacaatgcgatacgatcgatttacggaaacggatgtacaagaattttttgattattattatgttgaccgaggcatcattaaatggcagggatactatttatccgaccatttaagtgcgttgaaaagggatgctgaacagcgaacggcaaaactacaatgggatgaaaaccaccatgggaccggagcagagccagggaaaggatcataaaaaagaacgtcccgaggaggacgttcagcggttagaaagaaaagataactcgatatattttttgagtgcggagaagcattaaaaaatacaagcgaattcgcaactttatgttgcaacattataataagacaaattgagattaagtgcgtctcaatttttttagtttttgagctaaaattaaaaaagcatgataatgatataagggataacttttatttaagatatatcattttcgagcggagataaatgggattctgaaacgaatatttgtaaggcataataaattaaaacaaatatgtaacaacgttattaaaaatttaaactttatttggcaaaaataaaaccgcaatgagtctgcacgactacattgcggatggaaacattgcagtagtagtagaagtttatcttcacgttggctgacatgaatcgcggcatatggggaatacctaacttcggacaagactactgcaatgatgtttaaaatataattgctaaatttatagttagttatcaataaggataatgcaactaattgatagtgaactgatatttaatcgattaactcagacatccttaaaaaagatttctaaaggtacgttaaaatgctcatgaatcaatttgacttcagagagcttaaattcacttgcgccgtttaacttacggttcagggtggtccggccaatgcctaaaaaatttgcgaccgtttcctgtttaatttgattttcttttagataagctaagacgccgcgaaaatcccggtagttatcacacaaaaaaatcaccatccaattagttcgattttttgttccttttaaagattcctcttgtgggattataaccctaaaagggtctccttatcaatgctttgtactctattcggtataaatgtactagaattaatacatctagtagtaaggaggatatacctttgatttttggaactatactgaaaaatgcacgaaagcaacgaaatctgtcacaaattaagttgattcgtagtattcatgatgaatatggcattgacatatcaactagtatgctttctcgttatgaagatgaattaactccaataccgaagcggatgtcaatcgaagcgctatttgcattggcagtttatttagacctggatttaaatgaattagcacgtgaagaaattaaacaaatcagcagtaaaaaacaccattaacagagctaggacaacctcctgatttgttaatggtgaattagtatagaggataatgatatatcgggtagtttacgagtgctaactgaaaactagtaattagggctgaattcagcataattactgttccgggtgagcatgataaaataatttttaacgtaccttttgaacctaattttaaaatcaacaaatttaaaatgcttttcgagaatttttaagttcttgaaaagcattttttagtctatttttgttatgaaggcgtaggggcttaattatcgcgatcagttgagtaatgctcgtcttggtgttgtttagcgaggtccacgctacggtaatagtgcgcagtcagccacatgccggccccgccagcttgagtaaggacggtgaacggctgtccgccatctttttcggtactagtataaaagtacgtgccgtctccagcaccttgataccagccgcggacgttgactacttgcgaaactttgctagggtcgtcaaataaacttccagaagggctggctaaccctccggcaccccaatcggttttagcaggatcgggttttccgccgccattcaatactttcatgtcggctgcggtacgggaagctccgtcgtaggtcggggttttcacgccgtccgtattaaggaggttaccagtaacaactaatttttctattttgccatcgtcatcagcggaataccaagttccctgcatccattgtggaaaaacaaatttaacgtaatggtgcgtaggagctaccgcttttttagaagatgaggacttatttggcaacgctacttgctggcccgcaacaatcttagcgaatccttgcctaagcgtctgattctcagtagtggtgaagtgggtaaggttgtctggcattccctgattttgggaagtgtggtacacgacgggtttgccatctttaatggcgaacaggtaaacgtgaccgcctaaggtaccttgtccgggatcttcatatactgctacgacgttaacgcgataatgtcccttcccagtgggtgcccatcccgcggaaagcttttgatcatcaaaagcagtgcgttgctgtttgagatcgtcagggtaatgcaatccggcgtaagtggtgttatgcccgggagtacaagcagtataactttgatccatcgtttgaccgaaggattccataaagctgctaagttgttcagctttccgttgatcccacagcgcgcttggggttgctttgtgggtggttgagcgtgcttgactcgatttagtgaggtccgttgcggtattttggtgcacggacgatgatgaagaattagaatttccgcaggcggttagtaataaggctcccattccaatactagctaaccagccgaaagttcgttttaaattctgcaaaattactcctccaaactgaataattgtttacagtttatagtgtaccttaattaatgaggtttagatacagttgatagtctaccggggtccgcaattgtaagttagctttaacaattggcttttcgtgtccattgattatccgggtctgttgttctaaagactgaaaatcaaaatctaccaggccgagatagtagaaatccgcaccttcgtcctcacttttctttacgaagaggggaaaagcgatggtttgttgccgatttcccttaagaaggtggaccacttctttagaatctaacttacgaggcgttttggtgaaccagcttaacgtctgggtatcgtagaaaacgttttggtggcgagcagcaaccggagactggggacgtttttggtaaataacaaaaagcggacaacttccttgattagctttgtagccgtaaatcgcggaagattggtctttaggccagcccaataagcggttgacgtgtcgacgggtgtaacgttggttgcgggtgaacttcgtttgttggtcgtatcgtttgctattccacatgccaacttgtaagacatcgtcaaccaagtctttaaagtacggattttgctggtattgtgcccagagctcatcgttaagctgatagtaaccatcttgcagagtaacccaagctgtttgcccgtatttaacttgatcacgaggctgaaaataacttaaatcgagatggttgtttaccgactgcaaagttgctggatcagtataagttcccagttcatgaagttggctgaccaacgcttgcttagcgtaccggggctgtttaaacaactgttgtagcaaaactagttcatgaatgcgcatgccgtttaaaaattctcgtgaaattaggcgtaaaaaggcgtctgctgacttagtaaggggctgttcgtcatgcattttaatcaaaaactgctgatagttttcgtacttgtcgactaaaacttgaccatctaccgagccgaatttttgaaaatcagccaatcgaggtatgcgtcccaatttgtttttcaatgcttgataggcctcgcgtaaggttgccaacagggtgagattactatggttgatcgactgatagatccgttccttagcaattcgactaaagttaatggaagacaacccgatggtttggttggtggcaatttgttgccgaagccgatttttattcagggattggtcaccagtcaacgcaattgggattaagtagttgtttttgtaattaccaataaagtcaataatcgttacgaaagattttcccggagcttttcttaagccacgcccgagttgttgaatgaagatgatgctggattcggtgttgcgtagcataatcacttggttaaccttcggaatgtcgaccccttcattaaaaatgtcgacggtaactaaatattctaattcacccttttcaaatcgccgaatgattttttcacgctcactcaccgaggtgtttcctgtcaaagcaagggcggggtgcccctttgccgtcatgatttgagcgacctccgcggcttcagcttggcgactacaaaaaattaagccgtaaactcgttctccatcgtgaccatagtaatcaatttgttcagccacgtagttcatccgttcttgagcgagtaaatggcgtaacggagttttctcgtcaattaactggccctgatattcgtaatcggtaattcctacgtaatgaaattgactgagcatgtcggattcaatggccgcttgtaagcgaatttcataggcaatgtggtaatcgaaaagctcgtaaatgttaaaatcatccgttcgttccggcgtggcggtcatccctaaaagaaactcgggctggaaatggtcgatcacccgttggtaagtgggcgcaccggctttatgcgcttcgtcgattaaaacgtagtcaaacgtgtctgcgggcaaagactgtaaaactgactcacgtgacaaggtttgaatggtagcaaaaagatatttacagtcggtatcgtgctgatttccggaaagaattccgtaatcacttgccggaccgccaagtacttttcgaaaactacgtaaggatttgcgtagaatttgttcgcgatgaacaacaaataagaatttgcgcgggttaaaattgcgtacatcaaaagcacctaagtaggttttaccagttccggtagccgaaacgataaggccacgctttgccccggattgccgcaattcggttagtgaggcgagggcatccttttgcatggtgttgggggttatcgttggcgcaattaacgttggtaatttagttgagccaaaacgaggagcggcctggcgataggcttctttatattggtcgagccaagttttattaagcggctgggccgtttgccagagttgctcaatttcacgattaatggtgcgggctagctgtccatgacgctgggcagttagtttaatgttccattcgtagttttggattaaggccgcttcggttaaattagcacttccgaggatgaaagtttggtacccctcaggtttatcaaagaggtaggcttttgcatggaagttttgttgctgatcaatgattcgaacttccacgttaggaattttaagcagctcttcaaaaacgtgcggctggttaaaatacaaataagtagaagttaaaattcgtccggtaatattttggcttgccaaatcagcaaattgcacctttaaaccggtaagaaccccgttcgtgatgaaagctaccgccagggtgaaaccagtacaattttgcaattcctgttctaaatgaagtttaaggttgaccgtagcctgattagtaattaattggggaaggtactcatcgtcagccggcagctgataattactcagcgcagctaaaatcgaattattaaagttgggttcaagattcataagagctccttaaatacgtaatttatcaatgttacatgtattttaacgccgtttaggcagaagtagcgttaaatttaatttaaatcactttcggggggagtaattgagactgtcaataacgttctgtaacctaattagcaagcttttatcgtgggaatttgttatgtaggtgattaagatgtagttctgccttccagccttgttaactaaacgggactttgctacgaagccaaaacacgccccatcccccagttcgttgcggttaacccaatttcagtatagtagcaatatagataaaatgagttccacccccccagccttgtacggttaacaaaatcttcggacaaatccaccccgattcatccgaagattttgttaatcctccaagcctacccgggaggtttccactctctcatgctataatatatccaatcttttttcagcgaggggtttacaccatgcaacaggcaaatcatgcacgcaaaatcagtatcctagctttatttgcagccattattattattcaaaattacgtgcccttaatcggctacattccagttggtccattagaaattactaccattcatattacggttatcgtggcggcaattcttctaggccccgttgacggtggaattatcggcggaatttggggcctggtggattggcttcgcgcaattaccgttacttctagcgcgttaggcaacgtaataatggttaatccgctaatttcaatcgtcccccgaattctaatcggggttattaccggctggttagttaattggctgataaaaacgcgggttccacagcaagcgacgttcttaattggcgcaatcgtcggttctttagttaacacggtgttagtattgagcctgatttacgtcttctaccataacggttcccaagtatacacggcgctcaatttaaaagaactgatgccatatttactaacggtcgccgggatgcacggtattcccgaagcaattgctgctggaattattgcgccactactagctacgccactcttgaagttttctaaaatcgggcagcaacgttttaagcagtaaaaaattattttttgtttaatctcggggaaccggactattatttttaaggtgcttcggttaaactaagaatgtacactaaaatggagggtcttgaccaccagtggcgaagaaaaaacgtaggcgaaagaataactttttttatcagcagggacagttaaaagtttcgtcaattattgggctgcttttagtggtatgcttggtagttgaactgggaatgaagctccgcacggaagctacccaggttacggataacttgaccaccaccagtgtcaccgcacagcgtcaccaacagtttataaaaacaattgcgccatatgctcagcagatgcagcggcaatatggtattttgccgagcattacgatggctcaggcaattctagaatcagactggggacaaagcacgttgtccaaaaagtttaataattactacggaattaaaggtgactccgatcagaacagtcgttattttaaaacgcaggaatttgtaaacggcaaatgggtcacggtggcggcccgttttaaagtctattcttcgtggcaagaatcaatgcgtgatcattcgttactactggtgaacgggactaattggaatcctaggcaatatcaagcggtaattacagcaagtgattataagcaagctgcccaagcgctgtacgacgctcaatacgccacggatccggattatccagccaagttaattaacttgattcaaaaatataatttaaatcaatatgataaataataattcagggggagttacgggatgaagttacttgaagacaagattagatcagaaggaattgttttaccacacaatgtcttaaaggttgatggcttcttaaatcatcaagttgatccacaattaatgtttgaaattggaaaagaattcgcgcggttgtttaaggaccaaaaggtaactaaaatcttaaccgtagaatcttcagggattgctcccgcagtaatgaccggattggcaatggacgttccggtaatttttgcgcggaagcacaaaagtttaacgttgaaagatgacttatatacggcgtcagtttattcatataccaaacaaaccagcaatcaaatttcgatttctaaacggttcattgattctaacgatcgggtactaattattgacgacttcttagctaatggacaagccgtgtccggtttatttgacattgcggacgctgctaaaatcgacgtggtgggcgtcggaatcgtgattgaaaagaccttccaaaagggaagtcaaatcatcaaggatcgcaacgtgcaactagagtccttagctaaaattaaggcgttaactgacgatggtcaagttgaatttgagtaattatagattgaggaacaggcaggatgatcaaaagtggaaaatgaggtaattacttcgaaaaagattatttatccaggtgatatgattgggattatcggcgaagggcgttccagtgttcaattggtaaccaccgctaagtcgatgggctttaaagtttccgtttacgtcacgtcggagcaaaatgaagtggttcactatgcggataaaagtttcgtgggaagcttaaacgatggggaaaaacttcaacgatttgcggaacgttgcaaaattgtgatgtacgaatctgagatggtcgatattaagatcattaaatacctacaacaatttgtttccatccctcaaggaacccagttacttgagctcaaccaagatcgaatcattgaaaaggccacgatggaacaactcggaattaaaacggcaccgtacgttaccatcgtcgatttggatgatttatacgattcggttaatgagattgggtatcccggaattttacaaccaatcttgaaagatccgttgaatgaacaaagcttgctgttggaaagtgaaattgacgttcccaaggcggctccattgctcgaacgggggacctatttactacaatcatggccagacactggtcgcgaagtggcgttaagcgtagtaaagggccaaaaccaccggcaaaaaatgttcccaatggtggaaaatatctatcaaaaccatcacttaaaagaaacccgggttccggtagatattgatccgcggattcaaaataacctattggaacaagcaacgaaaatcgccaattcaattgaatacgtaggggtcttttcaattgtgttctacgtccaagatggagaaatttacttaaaacggttgattcctggaattcaccgttcccaaaatatctttaacttagcttcgaatacgacggtttacgaagaaaccttgcgggccctcagtgggatggtgatcagtgatattcggcttcaagtgccgaccatcatgttgaacgttgccgaaccgcaaatgcaaaaaattaaaacacagtggttaatcaaagataattggcacttccatttctatccgcaggttagcgaacacaaggatgaaaatcacgtgggctacgtgttggcggatggcgacaacgtcaagcaaattcaagagcaaattgataatacagatgtttggtaaaagtcgctttaaagtcggttaatgaaccggcttttttgctataatggtctgtggttgttttttagttacaaatagagaggattgaacgaattgcctgaaaatgatttattaaaaggtcttaatgatatgcaacagcaagccgtccaaacaacggagggcccgttgctgatcatggcgggtgctggtagtggaaagacacgggtgttaacgcaccgggtggcctatttgattgaagaaaaggatgtaaatccttggaacattttggccattacctttaccaataaggcggctcgggagatgcgtgaacgggtggctaatttattgggcgaagtggcatctgaaatttgggtctccactttccatgcgttgtgcgtacgaattttacggcgtgacattgaacagatcgggtacaaccgggctttttcaatcgccgaccctagtgaacaacggacgctgatcaaacacgtacttgcagatttgaattatgatccaaaagtatacgatcctcggtcggtattgggaaagatttccaacgccaaaaacgatttaatgactccggcggattaccaagaaaatgcaagtaacccgcatgatgaggcggttggtaagatttatgacgaatatcaacgacggttaaaagccaatcaagcgttggattttgacgacttaatcatgcaaacaattcggttgtttgaacaaagtcccgaaacgttgcaattttaccaaaacaaattccactatattcacgtggatgaataccaggatactaaccaagcgcaataccaattggttaacatgctggcaaaaggttttcggaacctatgcgtagtgggggattctgaccaaagcatttacggttggcggggtgccgacatgcaaaatattttgaattttgaatccgattatcccgacgcgcacacggttatgttggaacaaaattaccgttctacccaaaacattttgaacgcggctaacgacgtgattgctaacaacgtggaacgcaagcctaagcaattgtggacggataatgctgaaggggctaaaatttcgtactaccgggggcaaaccggcaatgacgaggtccatttcattgttcaacaaattcgcaaacaaattgaagaaaataattttgattacggtgattttgcaatcctataccggacgaacgcgcaatcccgattgattgaagataccttcgtgaaggccaacattccttataccatggtggggggacataagttctacgaccgcaaggaaattcgggacgttctcagttacctcacgttaatcgctaacgaagaggattccatgagttttgaacgggtaatcaacgaacccaaacgagggattggtgcaacttcaatggctaagctacaggcgtttgcggacgaaaatagttggtcgcttttacaagcggcgcgcaacgtgcaaattgctaacggaattgctcgacgcacgcgcaacgcgattgaagattttgccaagacaatcgatgctttacggaagtcggccgaatttctttccatcacggaattaacggaaactttactagataaaaccggctaccgggctgccttggaacaaacccgaaccatggaagcggaagctcggttagaaaatatcaacgaattcctcacggtaaccaagcaatttgacgagcaaaacgacgcggaagggaccgaagttgccgatgaaaatggtgataacgttcgcttggtggactttttagcagaccttgccttagtttctgaccaagacgatgtagaagaagaaccatcggcagtaacgctgatgaccctgcacgcggcgaaggggcttgagttccccgtagtcttcttagtaggaatggaagaaggagtcttcccattatccagggcggctaccgatcctgatgaacttgaagaagaacgccggttggcttacgtgggaattactcgcgcacaaaagaagttatacttaacgaacgcttattcccggatgttatacggaaggacgcaaaataatcctgcatctcgctttattggggaaattagcgcagaatatttacaagacgaaaacgaacaggttcaaggattcagctcaagcagtagaaacaaatatccgtttgatcgggaacgaaacgcccgggcaactgctagtgtttacggtactcaacgggctaaagtatctaccaaccaaggtactggcgcggaaaaagttagttgggcggccggcgataaagtgcaacacaaagcttggggcgttggtacggtggttaaggtttctgggaccggcgaagacgtggaattagacatcgcctttaaagatcaggggattaagcgtctattagcagcctttgcaccgattaagcgggttacggactaagcttagcattagacaagatgtgatttattttagcggtataattaggtatataacgaaagtttgaggaacttttctatgaaagtaactaaaaaaatcagtttattagttgccacgttattactcggagtcggtttgtcggcttgtgggggattaaataattcttccatgtcgtcggcaaccaataacgtgaccggtgaaaaaaataaaaagacaacttatcaaacaacgggctcctcttctggacaatacgccggagtgataaaaaacggaaagtacgtggtcagcaagtcccgcgggttaactgcggatcaaaatggcaacgtaaataatacgaagagttttgaaacgggcttgcaagacgtctccaaagaagtttttgcgccatccaaatacgttttccaagaggggcaatatcttagttcggatacggttcaaagttggctagaccggaagtccaagaagaaccctgatggtctcaatccgaaggataatggttctaaagatcctgataagcgaaacccaatttatttgcaagcacttgaagaacaagactacatgcaaaaatcggggaactccttgaagttgaagggggtcacgattggactagcaatgaacacggtcgactattatcaaaagaagcagtacggtgcagaatacgaaactaaaatttcggacgcggaaattaaagagcaaagtacgcggattgctaaagaagtactgcaacgattgcggaagaaagacgaattcaaaaatattccgattgtgattgccgtttataaacaagcgtctaatgatagtttgaccgggggaacctttatccggtattctaataatcagggcaatcagctagctagttggaaaaacttggattataagaacgtggtttacccaatcggggataacgaaagtacgccgaatagcaacgattcgactgcttttgataatttcaaaactcaagtggaaagtttcttccctaacttgagcggaattaccgcgaaggctcgttacaaaggggattcaatgcaaggaatgagcgtgacgattaccactcaattctatagtgagacagaaattaatagtttcacgcagtttgtttcgacccaggcggaaaaatacctgccaagcggggtaaatatcgacattacgattcgttcgagtgacgacgttcaaagcttcttatcccgttcatcaaaggataagacctttagttcgcacgtctttacaagctattaattctgaaaggaagcaagcaatgacagttgaaaataacattaccaaaaacgacgtagcacacgtagctacgttggctaaattaaaattagatgatgcccaattagaaaagtttacaaatcaattcgaggacatcatcgacctagttgaacaattaaacgaagtcgatacgactgatgtggaaccaacgttcaacgtaactgatcaattgaaccggatgcgcgaagatcaagccgttcgttcaggagataaggaagcactcttaaataacgcacccgatactgaagacgggttcattcgggttcccgcaattcttgatgaaagtgaggaagcataatgaagttttttgatattacggtgaccgaactccatcaaaaattggttgaccgggaattaaccgttacggagttggtatcccaaacgttagaccaaatcgaagctgaccaagccgttttaaacgactttgtcaccattaaccgcgacgaagctttaaaacaagcacaagcgattgacgaaaagggcgttgaccctgacaacttgtgggcgggaattcccattgccgtcaaggacaacatcgttactaagggcttaaaaacgaccgcttcttcaaagatgttgagtaattttacgcccatttacgacgcgacggtaattgaacgtttaaaggctaacgacgtgatcgtcattggaaaaaccaacctagatgaatttgcgatgggtggttcaacagaaacttctttctacggcacgacccggaatccgtgggaccacactaaagttcccggcggttcttctggtggctcagcaaccacggtcgcggctggtaattcgattgccgcacttggttcagataccgggggctccattcgccaaccagcttcctataccggaattgttggggtaaaaccaacgtacggccggatttcacggtacggattaattgcatttggttcaagtttagaccaaatcggtccgatgacgagaacggttaaggataacgcagccttattgaacatcattgctggaatggacgaacgggaccttaccagttcggataaggaagttcctgatttcacggctaagattggacaagacattaaagggatgaaaatcgcccttcctaaagagtaccttggcaagggaattaatgaagacgttaaggcaaccatcaagcaagccgttcaaacgttaacggatttaggagcaacggtcgaagaagtttccctaccacggagtaactacggggtggcggcttactacatcattggttcgtcagaagcttcttccaacttgcaacgttttgatgggattcgctacggttaccgggcggacgacgtaaagaacctagaagacgtttacgtaaaatcccgttccgaaggatttggcgacgaagttaagcgccggatcatgttgggaacttacgcactttcagctggatcatacgatgcattcttcaagaaggctgcccaagtgcggactttaatcatcgacgacttcaataaagttttcgaaaattacgacttaatcattgggccaactgcaccaactccagcttataaaattggtgcggaagttgatgacccaacgaccatgtacatgaacgacgtgttgacgatcccagttaacttagcgggattgccagcaatgtcattaccagcaggcttcagcgaagggatgccggttggtttacaaatgattgctaaaccatttgacgaacaaactatgtatcaagcaggggctgcttttgaagcggcaactaatttttaccaaaaacaccctgaaacggaggacaaataatgaattttaaaaccactatcggacttgaagtccacatcgaattaaaaactaattccaaaatatttagtccttcacccgtagaatttggggatcagcctaacgaaaatactaacgtaattgactggggataccccggcgttttgccccaaactaacaaaggggttgtggaagccggaatgatggctgccaaggcattgcatgctaacattgcccggacccagcattttgaccggaagaattatttctacccagataatcctaaggcctaccaaattacccaagcggatacgcccattggaacggatggctggattgaaatcgaagtagacggcaagaagaaaaaagttgggattgccgaaatgcacatcgaagaagatgctggtaagaatacccataaccctaatggctactcctacgtcgacttgaaccgacagggaaccccgttaatcgaaatcgtttctaaaccagacatcgaatcaccggacgaagcttacgcatatttggaagcacttcggcaacggattcagtttactgggatttcagacgtgaagatggaagaaggttccatgcgggtagacgttaacatttccatccgtccggaaggctcaaatacttatggtaccaaggccgaattgaagaatatcaattcctttaacttcgtccggaagggattggcttacgaagaaaagcggcaacaaaagcttttgttatccggtggagaagtacgtccggaaacccggcgttacgatgaagctacaggtcaaaccatcctaatgcgggttaaggaaggcgcggatgattaccgttacttctctgaaccagatttaccaagcatcaccatcagtgatgaatggatcaaggcggtagaagacaagatgccggaaatgcctggtaaacgacgtgcgcgttacgttaacgaactgggcttaagtgactacgatgccatggtgcttacccaaacgaaggaaatgtccgacttctttgaagcagcaattgcctttgatgcagatcctaagttggttgctaactacttaatgggtgacgtaaacgcctacttgaacgatcaaaaggttgacttacaagacacgaagattacgccagaacaccttgctagcatggttaagatgatcagtgacgaaaccatttcttcgaagattgctaagaaagtcttcaaggcaattactaagggtgaagaaccagttagctgggtaaaggaaaagggcttggtacaactttctgatccagcagttttgaagccaatcattacgcaagtagttgatgataacgaacaatcggtaattgactttaagaacggaaaagatcgggccgttggtttcttagttgggcaaatcatgaaacaaactaagggacaggcgaacccgaaggtggtaaatcaaatcttaatgcaagagctcaacgctcgttagtggaatagaagcggaggaaaacgtgcgatgcgaaaacgtgcgcgtattatatacaacccgacttcaggtcgggaaatgatcaagcagcatttagttgaaattctggcggtatttgaaaaggcgggatatgagaccagtgcatttgcaacaactccggaacctaattctgccaaaaacgaagcgcaccgagctgctaaggatggttttgacttagttgtggcagcgggcggcgacgggaccattaacgaagtggtcaacggaatcgctccgctccaccggcgccctaaattagcaatcatccctgctggaaccaccaacgactacgcccgggctttgcggattccacgggaagatccggtggcggccgcaaaggtagtgctccaaaatcaacggatgaagatggatattggtaaagccggtgataactacttcattaatatcgcagcgggtggtttgctgactgaattgacttacgacgtgccatccaacttgaagagtatttttggatacttagcttacatcgtgaagggggcagaaatgttgccccgggtgaagccggtcgagatggatattgagtatgacggagaacatttccatgggcaagcgtccatgttcttcttggcgttaactaattcaatcgggggctttgaacaaattgtgcccgacgcctcgttagatgatggaaaattcaccatgatcatcgtgaaatctagtagtttacctgacctgttacacttgatggtcaaggcgcttaacggcaagcatgttgacgacccgcggattatttaccggaaggcgcgtaaggtcgtcgttaacccggttaatgaacgggtcatggttaatttagatggcgaatatggtggtgacgccccaatggttttcaagaacttaaaacggcatatcgacatgtttactaatttagatagcgtcccggtcagtgaaccggaagacgatgagtaccgccaagttgaagaacaatttgttgctgaagttcaaaacctatcacaggatgatcaagagtgattatgcaccgtgactaactacggttgattacttctaatcgtcatgcattaaaatcaaaagtgtttttcaaggaaccataaagcactggaaagcattttgaaccattaacttaaatgaagctaaaatgtgggacaaaagtcagtttgctccgcttaacctgaaatcggtaattccggcaacatcagtcggaaccggcgatttccggttaatgcttacaaactacccggcttttgtcccactctgtttattagattatcaataaggggaaatcaatgaaaattaaagcaccagtagaaaaaaaccaaacgtatacggtcgacattaccgacttaacttatcaaggaatgggcgtagctaaaatcgagcattttccaattttcattgccgacagtatcccaggcgaacaaattcaagtcaaaatcactaaagtgcagaaaaattttgcgtttggccgggtggaaaaggttctagtggaaagcccagaccgggttgcgggaaacgatgctacgtatacgcaaacgggaattgcaccgttgcaacacattgcgtaccccgcgcaattaaaatttaagcaaactcaaattaagaacttattgcaaaagtcccacttggaacaaattgaagttgcggaaacggtcgggatggaaaacccaacgggataccgaaataaagcgcaggttccggttcgaaaagttaagggacagttagccaccggctttttcaagcgcggctcgcatgatttagtaccgatcgaagatttttacattcaagacccggtaattgaccaagtaatcctccaagttcgggacattttacgcgaataccaaattgaaccttacgacgaagttaaccaacgcggcgtagtgcgcaatatcatggtccgtcggggccggcgttcaggcgaaattatggtggtgttgattacccgcaccagctcagttccccatttagacgaaattgctgcagctattcatcaaattgatggggtagttagcgtaattcaaaatattaaccctaagcagactaacgttattatggggaaggaagatcgcctgttagctggtgaatcagttattcacgatgaattgttgggtcaaaaattcattatttcagcacattccttctaccaagttaacccagtgcaaactgaaaagctttaccagctagcaatcgaaaaagccggcttaactggtaaagaaacggtcttggacgtttatagtggaattggcacgatttccctagcgatggcgcaagccgccaagaaagtttacggagtcgaaattgttaaggaagccgttcaggacgcgaaggttaacgctgtccaaaaccaagctaagaacgttaaatttgtggttggcaaggcggaagaccaaatggcgaagtggcaagctgaagggatgcaaccagatgttgtggtagtggatccaccacgcaaaggcctcgacgaaagtgtgattgacgcaactgtggcaatggctcctaaacgagtggtttacgtcagctgtaacccagcaacgctggttcgagacatcgaccggttccaggctcaaggctacaaggtggatcaaccaatcacgccggtagaccagttcccgcagacgccgcatgttgagagcctcacagtaatgtcgaggagctaggcgacgaagaaataataagttttctgtaaatggaaactaaaaggcaaaattaattagttaaaatgcttagtaaactaaaaagtgtacccctattgaatactggggcacacttttttacatatggcagttattttaatgattacccgctaagttagccaaaataaggccaatgacaattaaaatgattctggaaatttgtaattgtagggtattttcttgaatttcctaaccctctttgataagctcaaaacaaattcattaaggagaaggttgaatgattaattacagcaccttagcgattgtaggttagccagaaggtttggcttacaaatcttctggaattgccattaaattcaattcttaaggggatcgttaaaatggaaaaagattatttgattcggttagaacaaccagctgactaccggaaaacggaagcgatggttcgggaagccttttgtaacgtttatcggccaggttgttatgaatattacgtattacatgtcttacggaaaagtcgcgagtttgtccctcagcttaacttagtgatggaaaaagaccaccaaattatcgggcaaatttgctttgtgaaggcaaaactggttgataaaaacggaaatgaagtacccgttttgacatttggaccgttatcaattgccccggcttaccaacggaaggggtatgggaaaaagctgctcgattatggcattgctcaagcacgtaaatggggtgcctctgcactttgcattgaaggcaacttagccttttataaacacgctggttttgaaattgcgaccaccaagggaattcgttacgcaagtgaacctgaaaacgtagaactcccatattttttggcaaaggaattacgggaaggcttctttgagcaagtacaaggagcactctactacacgccttcagcatattacgtcagtgaaagcgacgttaataaatttgaccaacaatttccgccaaaagaaaagcgcgtccttcccgggcaattagcttaacccaaaaaataaacccgtcacgattacgaggcgcccccgtctttaagtgacgggtttagcttttttggcaagtacctttgttataatagagttgaaggaaaactttagccgtggtggttaggattcaacagtaaaagtttgaaagtaaaaaagcgtagaaactgaatcaaattcagcttctacgctttgctacatacaagaattaattttgggcgttataggcgtcaaccaagtcctgggcgaattgatctaggtgatcgagatcctcttgcgattcgggagctaagttaatcttaagatcggcagttcccttagttgcgttagccttagtgagagcttcactaaacttgtcaacggcgacgcaataaaattcttcgtagaatgtgtctcctgatccagcgactccgtaaattttgccgctcaaatcaaggtcggccaggtcgtcgtaaaagtcgagcccctcttcaggtagtgccccttcgtcataggtgtaggggacaatgacgttaatgtcgtagtctttaagttcggcagcgtcggtttgtgaaatttcggtttcgtcaacttccacgcctaaatcttctaaagcttcggtaatgatgtcagcacagtcctcattattaccagtgatggtagcaaaaacaacttttgcagttggcatagtttgatccttctttccaatattttcctatcaaagtatagcaaaaaaggagttgattaacattaattctgaagaaactaaaaaaattactaaaattaccgcacaaaaacgagctgggcgttacaacgtttttttggacggcgagtacgcttttccaattagcgaggaaaccttcattcactttcggttgggtaagggaatggccatcactagcacgttattaaaagaaattggcgaatacgaaaccaatgccgaagcatacaacatcgcgctgacctatataaccggccagttacgcacggaaaatgaagtacgccaaaaattgcgtcagcaggattacgaggagtcggtaattgaagcggtgattgctaagttagctgatttgaatttattagacgatcgggagtacgccaaaagctacgtgcgcacgatgatgcggacgggcgacaaggggccccggtacctaattaaccatttacggcaaaaaggggtgctggaaaacgacttgcaagcgggattgcagctatttactgacgctgaacaggtggctctagcagtccgggtcggacagaaactgcaaaaacggcatcaggcacaagcactccgacaacaacagctgaaaattcggcaaaatttggtgcaaaagggtttcactagcgaaattatcgaaaaagcactcgctgaaatcgaatttacggtcgatagcgatgcagaatacgaaaagctacgtaaattgggcgaacgactgttacggcggtaccaagggcaaccggaataccagcgaaccactaaaattaaacggtcgttatatcaaaaaggctttgaaatggaattaattgaacgttttttaaacgaaaatgattcttaagtttctggaatggatagtgcaaaattaaagtccactttggtataattgaagagaaattgaaagctttcagctgtaggaagtaggcttatgctatgtctcaatactcagatggaccaaaggaaggcgagtatattgcgataaaaagctataagcatgatggtagtttgcatcggacttggcgtgaaacaatggttctaaaaaatagtcaagacgagtttattggctgtaatgatcacacggtggtgatcgaggataacgaccgccgctgggtgacccgggaaccggcgctggtttattttaataagcatacttggtttaacgtggtggcgatgattcgggataacggagtttcctattactgtaacattgcgtcaccatatgttttggatcgcgaagccctcaagtacattgattacgatttagatgttaaggtgtttcccaatggcgaacggcgccttttggatacggacgaattcgagcagttcagtcggcagtggcactattccgcggacacgattcagattttgctggatagtgtacgggaactgacggattggataaataaaaagcgtggaccgttttcggttgagtttattaatatttggtacaaacgttatctgaatatagcggagcgcaatactcggtaaaaaagggaggtgtgaagagcacttcccttttctttaaaaaagaatacactgaacatagatgaaaatgaggagtctggtaaatgtttgaaaaatttcgtaaaacgcccttaatgtactggtcgttggaattgttaattattgcgaccttactgtgggtttgtactaaaattgattttttgtttagcccgattggaacgtttattagcacggtattcatgccgttaatcttggcgaccttcttatactacatgctccatccgttggtgaagttgttaatgaaggtccattataagaagtttcggatatcgcgtacctgggcggtggtgttggtattcgtgggattcctgctcctaattgcttggggaatcagctctttcttgcccagtttgatcgatcaaatttcccaaatgttagggaatttaccaatgattgccaagaaactgcaggttgccattcctcagctagtcgaccactcctggctgcgcaaagttgattttgacccgtatctaaaaaatctgaatagtgagattggtcaatacgcggagcaatttttggcgaacatgactaacagcatcggtaatattattgcggcgcttactaacatcacggtcatcgtgattacggtgcccattattctgttttacatgttaaaggacggatacaaattaattccgacaatttcgcggattgtcccagaacacaaccgcaaaagtgtgttagatttattttattcgatgagtgacacgctatcttcttacatttctggacaagtaatcgaatgtattttcgtgggaacctttaccgtgattggctatatgattattcatcagccgtacgggttggtgctcggcgtgatcgcgggaatttgcaacatcatcccgtatgtcggaccttattttgggatttttccttcgttgctagtggcgattgcccagtcccccgaacaggtaatttcggtaatcatcgtggtcttaattgtccaacaagtggacggaaatctaatatacccgaacgtgattggcaagtccttgcaaattcatccgttaaccatcattattttattgttggtagcgggaaaacttgcaggaattttaggaatgattttggcggcaccgacttacgcaattgttaaagttttaattaactttatccaccatatctgggttttagacctagataagattgaagaaaaggttaagccagaaaaataggctaaatttggtagtttgctattaatatggtaatatctacagagttagataaattatttcaaggagaaaaaaatcttgacaagagtaattacttacgggactttcgacctgttgcataaaggacacgtccggttgttaaagcgggcacgtgaattaggcgaccatttgacagtatgtttatcaacggacgagtttaatgcggttaagggcaagaaagcttacaccccgtacgaagaccgaaagtatattttagaagcgattaaatatgttgacgaagtgattccagaacgcggatgggatcaaaagataaatgacgttaaggaaaatgatattgatattttcgtaatgggcgacgactggaagggtcaatttgattttctcaaggattactgtaaagttatttatttaccacggaccgaaggaatctcgacaactaaaatcaagcgtgatttaggtcttggtgattataaaaaagattaagacaacagttaagattgggatatcaaaatgattccaatcttattttttagagggaaaggaacgaatatgaaccaggcagaattaaaagcggcggttgataagcgacgcacttttgcgattatttctcacccggatgcggggaaaaccaccattaccgagcaattgctattgtttgggggcgtagtgcgagaagccggaacggttaaggctcggaagacgggtaactacgctaagtcagactggatggaaattgaaaagaagcggggaatctccgtaactagttcagtgatgcagtttgattatgcaggaaaacgaatcaacattttggatactcctggacatgaggacttttcggaagatacttaccggaccctaatggccgtggactccgcagtgatggtgattgattccgcaaaggggattgagccccaaactaaaaaattgttccaaatttgtaagatgcgtggaattccaatttttacctttatgaacaagttggaccgcgacggccgtgaaccgctcgacctagtaaatgaactagaagaagttctcggaattgatgcttacccaatgaattggccaattgggatgggaaagggtctggcaggcttgtatgacatttacaacaaccggattgaactacatactgacgagcccgaatatttagcgcttgatagtaacggggaactaaaagaacctaatcccattgaagaagaaagtgtcttccaagacgcaatgatggaagtggacttgatgaaggaagcggggaaccaatttgacgaggctaagattgccaagggtgaattgactccggttttcttcggttcagctttaactaactttggggtaaaaactttcctagatgcttatttacaatttgctccggcaccatccgcgcataaagtggcggacggcgaacaaattcaacctactgacgaagaattctccggatttgtttttaagattcaggcgaatatgaaccctaaccatcgggaccggattgcctttttacggatctgttccggagaatttgaccggggaatggacgttactttaaaacggactggtaagacattgcggctttccaattcaactcaatttatggcggacgcacgggaaaatgttgaacgtgcggttgctggagatattatcggtttatacgatacgggtaatttccagattggggatacaatttacgccggcaagcagccggtacaatttgaaaagctgccgcaatttactccagaattattcatgggcgtttctgcaaagaacgtaatgaaacaaaaatccttccataagggaattcagcaattggttcaagaaggtgcggtgcagttgtacacaaactacactacgggggattacatccttggcgccgtgggtcaattgcaatttgaagtgttccaattccggatgcaaaacgaatacaattcggaagtggtaatgcaaccaatgggcaagaaaattgcccgctggatcaatccggaacaactggacgaaaaaatgtcgtcttcccggaatttgttggtgaaggaccgcgctagacaaccgctcttcctattcgaaaatcaattcgcggaacgctggttcaaaggcaagtatcctgacgtagaactcaccgcaaaactttaaaaaataaaactttctaaagtaactgattcagacagccaaccaagtaaattatgggctataatggataagttatttaagaaatatcatgtggaggaacgatagcatgaatcgtttatggggtaagtttcgccggggattgaacaccaagtttgggttctttatgttgattaccgggctgttttggctgaaatcatacattgcataccaaactaagtttacgctgggtgttcaaggtgggatgcaggaattaattttagccatcagcccccttggctttgccattctattatttggaattggattatatatccgaggtaaatgggcctattggtacatgattgtaatggatgcaatcttatcaacctggctgtttgccaacattttgtactaccgagagttttcagactttatcacctttaacttaatcaagggctcgggtgccgcatcggataacctgggaaaaagcttgatgggaattttacgaccaaccgactttttagtgttcgtggatgtaatcttcgtcattgcaattttagcgtttggttttgctaaaattgaccaacagcgtttcaagctggttaattcattagcggtcacgattctatcaattggggttctagccgctaacttagcccttgcttattcaaaccggtccggattgttgacccggacgtttgataataactacattgttaagtatttgggattacaaagcttcaccttatacgacggcgttaagaccgttcagaatagtaataagaagaaagaagccaaaagttctcaattaaaaccaattaacgagtttttaaagaagaataacgtgcccgccaacatcgaatataagggtgttgcgaagggtaagaacgtaattattattcacttagaaagtttgcaacaatttgtcattaaccaaaagtggaagggaaaggaaattacccctaacatcaataagttctacaatgacaagaacacgctagcttatgacaacttctttaaccaagttgggcaaggaaagacggccgacgccgagatgatgttagaaaattcgttgtttggattacctgaaggatcagcgatggttacggatggtactaccaacaccttccaatccatgcccgcaattatggatcagcacggttacactaccgcagccttccacggggacgtagctagcttctggaaccgggataacgcttataaatcatttggttaccagtacttcttcagtaagcaatactactcgttgaagaagggctacgtaagtggatatggaatgaaggataagttgttcttacaacagtccgcgaagttccttgaagagcttccacagccgttctatgcaaaattaatcacggtttctaaccactacccttacggaatcgaaaagaaaaatgtttctattgatccgtgggagacgggggattcaaccgtggatccatatgttcaaacggcccattaccttgaccaagcggttggggaattaattagttacttgaagaagaccggactttacgacaagagtttgatcatgatgtacggtgatcattatggaatttcaaacaatcataaacccgcaattgccaagattttaggtctaaaaggggttactaattatgatttggcaatgttccaaaaggtaccgttcatgattcatgctccgggtctaaagggaggcgtcaaccacaattacagtggtgaaattgacgtgatgccaaccctattgaacctcttaggaattgatacgccaggggcttatcaatttgggcacgacattaattctaaacagtataaccaaattgtggcgttccgaaacggagatttcgtttctaagaagtacaccaagtacggtggcgatttgtactacacggctactggggaacagattactgacgaaacggctagtcaaaaacgggaggttaaacaaattcaacagtacgttaataacgagttgaattattccgaccggatcattaatggtgatttgctgcgctttgcagacttagactggtttaagaaggtcaataaggcggattacagctacactaagaagacggccttgaagaatctgaaaaaggcgcaaaaatccaagactagtttgctcgaacaaaatcacggccggtccacggttgacgattacgtaaccgatgcaccggaattaccagaaaatgaagataaggcggctagttcgagttcttcaagcaacagttcttcggaagatagcagtcattcaggaagtagttccgctgatcctgctacccaagaagataaatagatattaacaatttaagggacgcacgattagcccaaacaaaattaagaattaacatggagaggttggaaaatttttcccaacctcttttgttttttagattaaaatactagttaagaatcgtggagttttaaaaacttaattaagttagaaggagaatttgatctatggcaagtcatttaatcattttactgctggtcggtctattggccggagtgtttggcgccatccttggaattgggggcgggatgattatcaccccggtcttgaccattgggatgggactcgatattaaatacgcaattggtgcaagtatcatcgccgtaattgcgactagttcaggtgctaccattgcctacttaaaggacgagatgcttaatttgcgggtagcaatgtttttggaaattgcgaccacggtcggagcgattgtgggggcgattatgaccgggatttttaattcgacggtcctctacgtactgtttggctcatttctcgttttttcgagttggaatatgtaccgaaagctccgtcaagggggtagtgaagagggtagcgcaaagaacgatcgtttagctaaccgacttaaccttagcggcagttactacgataaggcgctgcaaaaacaaattaattaccaagtggaaaatgttccaggaggttcggcagtgatgtttggcgctggattagctagcggacttttaggaatcggaagcggtgcgtttaaggtgatggcgatggataacatcatgaagatgccgttaaaaccttccagcgccactagcaacttaatgatgggggttaccgctgcagctagtgcgatggtttacttcttcaacggctcgattcatgctgacattgcgggccccttagcaattggaattttatttggtgcccaattaggaagccgaattatgcaacgcctgcgtccccggtggattcggttaatcttcattccggtattgctatacatgggcttacaaatggttttaaaaggatttggggtgaacttttagatgaacgctaaacaaaaagaaatgaatcacgtcgaattattgattggccgtattttacaagtaggggtttatatttccgcaatcgtcattatctgcggaatcggtttatggttagtaaaaaacggttcgggttatgctggtgccttaccaacccgtttgggagtgattttccaaggagctatgcaattaaagccttacgcagttttaatgttgggaatctttttactaattttaacccccgtcttgcgggtcgtggtgtcaatctacgcctttgctaaggaaggggatcgattgtacgtagcgattacgacaattgttttaattattttaattatcggtatgacgattggttaccaagggtaacaacgattaaccaagccaggaaagttgacaaactttcctggtttttttagtaggaaattattgttgaaaggtagtagaggtaaaaattatctagaagtaagattacgaagggactagcgaataataaaaaatgaacgctaattgatgacgtagacaattcactatgtagaagttataattaacgagatggaattttaacgaccggtataattgttgtgccaaagcatagatgagggagttttatatgaaagtggaaccaaacgtcgtaataagtgaattcatcgttaatatggtcgatgaacttcacggagcagacaatagcaatgtagacgttgctgaaaaagtgaaggaacaagcagactctttggcggattttaaagttccttattacgtattaacgaacgggccgggcagggaacacgttgatgatggactaaccattgttcatctcgacttatttgaacattttcctaacttaactttgtatttccaacggcttttactggcttttgactttttaaaagcccacccagaaattaaaaaagctgctctaaccgatgcggctgatgtaacaatgcttaattatccttttgataatgtacaagagggtattttgtatatgggtgatgaaacaagcccaatttttaacacgtcgataattattagtaatgatgcccccacctacatgaggaattttatttgggaaaataatgatttaccaatcctaaatttaggtgtgatggtggggactcgggatgttttaatcgagtatttaggaattatggttaaattaattaccgaagccgaattgaaattcaaacagggagatgcttcttacaatttagggcattttgaaatgttgatttcaaattatgtggcctaccgttattttagtaaccgcttaattcacggtcgagaggttagtaccatttttaacgggttccaagaacgtagtagcgcctggtttaaacataaataagcgggttaagggatctaaactaagcagtggttagcaatttgactataaagaaatgggctgggaagagagcttagcaaagctattttaaatcccccgtgggttagattaagcagctttgaaattaattgggtgagagccgataattttaaggctgtttttgtataaatgataatttagttaatgcaaaaaaataattttctattttatgctgtttttttaaaatcttgagacagacaatcttggttaagggtgtaacattaaagggtaatataaatcaagaatgttaaattatgaaagcgttggctaatttatacaacaaaatcagtgaatataaaaaagaaccttctcaattacgtaaggtccctaatccaaaataggaactagttagtgatgcatgaaaccaacggccatgtaaactaagttacttaagataattaagaagaaaactacggaaataattttttccggtgcttggcccttctttttcttttgtgtacgcggaggagtttggatttccttctcataagatacccttttttcgatatccttttcaagtagctgacttttttgttcggacgaattattaatgggaaagacctcctttaattacgagctgttcttaatgccatttaaacaattttctacttaaaagtaaataggctaagtaaaatcgcaaaaaattaacgtcatgtaacatacttcctgtaaaaaataaacgtggtgtgttacattgaatgtacgataaagaatagaggtagacagatgagattcgattttaatgactttcgtctcagaaagtattcgaaaatcactaaaaagattttagctttagataaagaataccaacaattgacggatgagcagttgcaagcaaaaactaccttctttagagaaaaactcgcacagggtgcaagtttggattcgattctggtagatgcgtacgccaccatccgtgaagctgattaccgaattttagggctaaaaccatttgaaaaccaagtgctaggtggcgtgattttacactttgaagcagtagcccagatgaataccggtgaaggtaagaccttaaccgccaccatgccaatgtacttaaacgggctgactggcccgggtaattttttggttacggtaaatggatatttggcaaaccgggatgcggaagaaaccggtaaagtttaccactggatgggtttaactagtacggccggagtaagcgaagatgacgaagaattagatatgcatgcggtttataaccatgacattgtttatacaacgaatagtgcgctgggctttgattatttaactgacaacttggtggaaaatgtcacagataaaaagcttaacgatttaaattttgcgttagttgatgaagtggattccgtgttacttgatgctgcgcaaacgccattggtaatttcgggttctccgcgggtccaatcgaacctttttaactcaacggatcgcattgtaaaaagtttgcaaaaagacaaagattacgaatttagtgaagatttaaagagcgtttggttcacaaaagcaggaatcaaacatttagaagagtatttaggagtagacgatttagtttctccaaaatggtccgaattatatcgtcacttggtattagcactacaagcaaattatacgattaaacgtaacctagattatgtggtggtcgataaccaagtactgcttttagatagcgaaaatggtcgggcactgacggggatgaaacgtgaatctggaattcaccaagcgatggaagctaaggaagaagtcccccttactgatcaaactcggtcaatggcttcaattacgttgcagaatttcttcaagatgtttaagaagctttccgggatgactgggaccgcggttacgtctgcccgggagtttatggacgtttacaacttaccggtcttaagggtgcctacccataaaccgaatattcggatagaccgtcccgacgttgtttacgcaaccatggacgaaaaaattgacgcgaccataaaattagtgaaaaaagcatatgaaattcaacggccggttttgttaaaaacgggttcgttatcgttgtcgagattatactcacgggtgctgctcaaaaatgggattattcataacgttttaaatgcgcagagtgcgtctaaagaagcgctaatcgttgctgatgctggacaagccggtgcgattaccgttgcaacttcaatggccggtcggggaactgatattaaacttggccctggagtaaaagaaaagggcggcttgttggtaattggaacggaacgaatggatagccgccgggtagatgaccagttacggggggcgcgccggacgacaaggagaccctggagaaagtatttttctagtttcacttgacgataaagtggtgattgagaatgctcccgaatgggtagaaaagtatcgaattcgtttagcacaagcacttaaagatggtaaaagaaaatacggcgaaccgttaaaaggacggagcgatcgaaatattgtagaacatgcgcaacaagccgcggatgcacaagctgaagcaggtcgtaaaagttctgtgaaaatggacgataccttacggattcaacgtgaaatgatttatgattttcgtgattacgtaatgtctgatggggacttgactgaaattacgcaacgaatttgggataacttttttaaagcatacgcgcgccaaaagaacctaacaagggaaaaattgagcgactttatcatcaataatttggattataactacaacaatttacaaatcgattctaaaattctggaaagtcccgaacaaattgagcaatacgttgtaaacattgcaaaacaaaaatgggaagatcaaaaagtaattttagataacgaatttaagcaaaattacttaaagaggctgtcaattttaaaggcgttggacatggcttggattgaacaagtggataacctgacacagttaaaaacggtagtatctagtcgggcgttaggacagcataacccgatatttgagtacgaaaaagaggccatgaattcatttaaacaaatgaagaaatcattttggcgcgatacgatcaaatatatgttgttgtcagatttgatcgttggtaaaaatgaatcaattaaggtggaatttccatgagaaaaagtagtgaaaaaaaagagttggtttctagcattgcctttacgctgtttatgattattttaatggaattaggccggcaaattgctgttccaggcttagatcctgaaatgagtcgtaaagcattgaatggttcagctttattgagaaatgtttcaatgcttactgggggacagtataggtttgcatcgctattttcgattggtttaggaccatacatgactgggatgattttatttcaggccgttcagttggttaatactaatttaatggacaagattagtgattcaaaacgaggatatatccaacggtggattactttagtaattgcgatacttcaaacactacaatttatgtttgtaattcgcgatcaaatcaccccttcaggagtcaaactatggggctttgattttaacgtggcaacggcattcatggtcttagttgcgggagcaatgatggtatcgtggatggctgacatgacaactaaatacggggtcggcggtgctggagttatgattatgccaggaatcttcattagcatgccaatgatggtgatgcacggtcccggagtggggagctaccaagttaagacgttttcaaccaacctttggatagccttaatagtatcagtattagtggtctttattgctaccgtatttttcaataaggcagaattaagaattccgctacagcggccaaatatccaaaatgatttttcagaatcatacttaccaattcgctttttaacttcaggaagcatgccattcatgtttaccactacggtgtttattatgcctacttatattgctaattttaatccggatagtggttttagccattttactcaaacgtacgttaattttagtaatccagtcgggattgcaatttattgcggagtcgtagtgttcttaagttacgcgtttagttttatgaacctgcaaacggaacgccaagcagaaaatttaaaaaagtcgggagactatatttttggaattgcgccaggtaaggataccaaaaaatatttgaattaccacgtaattaggttaagtacagctgccaacggatactttttaacagtaatcgcaaccccattaataattgggttatacgtaccgggcgtaactaattttacgtttgcgtattctagtattttaatcgtggttacgattatggacactacgttagaacagctaaagacaatgtacttaagaacgcagtacgatcttttgtaagttataaggagtaaagcgaatgttttatattgccccagcatggacaaatgatattaaagaattaaatcacgatccgttaaaaaacttgatcagtttgttaaatagcggggataaaccagtaaaattactggtactaaatttcttgcctaatctaaggtatcttttacacgtaaatggattaactaacctcccattttggaacctctgggacgccattttagggattgagcgaacggacgggatgccgcttggcccggagagtttagagatccctgatgacgtgcgaatagtccaggggccttgggcaatgctcggataccgaggaaatgaattagcagcaacgttgattggtaatagtcaagggtttgttcagactgtggaaaacattgagtctggaaaacacttttttgatatctacgatgaccgtggattcaaagcttcaaccaagtatatggatgaggatcgattagtccggcaagattggtttgacgaagttggacaatgtgttttgcgttatgaacctgatgctaaagtccctgtacgaattttaagtaattacgataattttaaccatactgaatacgctagtttggatgatgtatatctagaatttgttaataagaaatttgcaaacgaatttgatccccaagcggatggcttaattgctagcagtggcgaaatgattcgaccgctgatgcttaaaattcaaaggcagatgccagtcacttatgtgttagatcaccaaggaacggttgattcgacagatattaaaaaattaactccacaaattaggggagcagctagctttgtggttccgaattatgcaatttttgaacaatttcagcttgaagttgatgaacgtagtcaaagccatttagagctaggctatccgtatggcgctgacatgcgtttaggaaatagtaatgaagaacgccaactaattgtttattggaacattggtgatgcaaatgatgattctaatattacaaacgcgtgtaatgaattaatggactattatttaaaatatgaaaatactgggttaataatagcaacgcttgatgaagacaaggcgaggatcgtatcttcaaaaattttggacaagataatcggccaatacgattttctcactgaagctgaagaacgggaaaacttagataagattttacgtaaccccaacaacgcaacggaagtgcaaaatttagtaaatcaagtacggttccgactgtggcaagaatggcaaattgaacatccaattaagaatggcgaaatgacagtaacggttggcgaagaagcgccaagtgaaaaaattgactgggagagatttgctaccgacattgcgaacgtccttattagggtggagccgcaggactatcaaatttttgacgatttatcacgcgcaagaattttggttgatatgggcgaaccgtatgacgcacgaatgcagtttaatgcgattagtgccggaattccccaaattaataatgttgaaagtccgtttgtaattgatcaggaaaacggatggattgttaaagaggggcacagtttaacgcaagggctagatttttatttgaaaaaattaggcaattggaacgtagccttggtaaacacggctaaatatatggaacaactagaatttaggcgtcaatccgattggtgggagagaaggatacactatgagtaaaatgaaaattatacatctggggcccaagattgaaggattagcagaactaattgagaacgactttgaaatttttgacgttccattggaagttgttaatcagccaatcggtaaagaaaaaaagaagttgctcatcaagggagaactaaacttagcttttcgccatgatatgtttttaattacccaaccagaatatttagctgctgaacaaagcagccttttaaaagaactaccagcaaataacattttgatagatgaccggctggaactttctaaggaagctactcaggcgctccacctgaaaaatgctcaattcattagcattccaaatgcagagaatttggccaagcaatttaaagaggtattttataatgaccaacttggttttaaatacacttttgataacatccaatttgattctctttttaagggaactgtaaaacaattgggacataattatctaagaattatagataatgatattgaggaataccaacgagtggctaattgggatggcccgatcggtgttgggggaaatacgctctgggaaattcatacggaattcaaacgtaataaccccactactaacgttcggttacgagtttcactaataagccctgcggatgctcaaatttactattccaaagaggtggataatgatcaactaaagaatgacattccactagaagtcaatgacgatggggccttcatccttgttgaactgttggttaagggtaaggatgtcgacctaactatgggagcgattactttaaacgagggtcgcgatggaagaggaactttgctaattggtgaagatatggaaattgacgatgaagcaatgggagaaccgctgtaccattactttgatcccggtgatttcaaaccaccattgatggtgtacttttccggttttcgttttaatcccggtgtcgaagggatgtacatgatgcggagtttaaagggaccaagtcttttaattgaagacttccgaatccttgggggcgcattctacgttgggggtaagaaattagagagccaaattgtcaatcttattcagtcaactctgaaaaaattaggctttaaaccaaatgaattgatcctatccggtctctcgatgggaacctttgctagtttatactactcatcgtttctcaatcctgactgggtaattgttggtaagcccttaactagcttaggtgagattgctgctaacgaacgcatcaaccgacctggcggatttccaacttctttagacgtggtattacggttaactggtggaatcgcggatgagaatattaagcaggccgacgatattttttggaattcatttactaaacatgatcattcaaaaactaactttgtaattgtctatatgaaagatgacgattacgatggggaagcatttgaaaaactggatcgcttcttacgtaagcattcaccgacgtcgcggatcattcataaaggatttactggccggcataatgatcaaactggtgctctcggtgcttggtttaaaaatcaataccaaaatatattaacaaccaactacggtcgtgactttagcccgcaggaggatgatgaagacgatgagtaactattttgtgattagatggccgttacgaatgaataatacgtacagctttggatcggtaatcaactatcaaaaaggcaaaatttatttcaaaaatgagcggatgagtccgggagaacgaatccacacttggaaatcaaaatttaattaccatattcgtgattctgaattttcacaattaccgttgttaaaaagaggggttaagtatcaggtaaatgctaaggcagaggtagttcccgggggatcggttcaagtccagttagatttctttgataatcgagacgaaattattgatggcccgctcaccattgatttagatggtgaatttgtagttcctgaagagatggatcactaccaacttagtttggttaacttgaataatagatcattagaattcgaaaatttagtgatcgaaccctcagaaagtgagtttgcagttgccacaactagtggttacatgaataccacctatatatggaaccgccaagacgatttttttgaagatgtagaagtctatttacgtagtcgactgctatattcaggagcttatttaggtaaaaagaataccctacgtatttttgtggagtttgacagtcgagctaattggcaagcacaggaattgcggaaagaaatttctacaacatttaagtcgtttgaaaaggtggttaggaaaaacaaaatggcgtttgacgcactatcgccaaaaacagttttactttcaccacaagaagaacggttaaccgcggtagaaaagtatgcaactattgaactgtcaaaaatattgcatttttataggcggtaaaaataaataattttagaaatcctatattttggaggaaaaatatgaatttttttgttaatgaagcaatgggaattggtaattcgggagtagaacacgcccaattttaccgtgcaaaacgctttgaccaagctaacttagattataaattcatcttcatggcactggttgataacctacatgaagcgatggacaagtggaacttacgtgacgaccaagtaattaatatttgggagtattttgtttacggtgatgattatgcattacatggtttaaagcagcgtaccaaagtaaagagtaagaacgtaattgatagtacgaacaccttacgattagagaataaagttactccagcgggaatccgggtcgttcggcattatgtgaagttccctaatccaaagaaaaatccacctttactggttagaattgaccggattgaattatatgatgcgcagactaatttgcgaaaagttgcgtttgaatttttacaggatccgcataacgatcaaggtaatcaaattgtaaatattcatttatataatcaacctaatggcgagctcttcttccctaactcagtccagttgcggagatactttttccatcaaattgaacggttatattctggaaagaatatcttcgttctagatcgtggagaaatgaatgaagttgctttaatggatgaagatatgccaaaaccaaaccggaaactagtggaaattgtccatgcggatcatttagctgatcgggatgatcctaaagcaccgttttggaataactattatgaatatgcgcttacccacatggaccggattgatcgaatggtggttgctaccgaacttcaaagaaaagatctattaattgattttccggacaggggaaaggaaattgtaacgattccggttggaggagtggatgacgaaattaaacaagtcaagggcactccgcacaaagaatttaaattagtcacgatttctcgcctagcatctgaaaagcatattgacttaattgttaaagcggtggctaacttacataaacaaggcaataaagttagtttagatatctacggtgccggcgaagaagacaagaagttgaaagaactaattgaaaaggttcaggctaaaaaatatattaagatgcgggggctcactcatcacgctgacgaagtttatcctaagtatgatgcctttgtttcggcttccttctctgaaggatttggcttaacctacattgaagcgttaaatgctgggctgccagtagttacctttgccgctcgttttggttctttagagttaattgaagatggtaaaaatggttacttaatgacctttaaacgagaagacttagatttcgacgtcagtcaattagaaaagggaattcaaaaattgatggatcgagacatcaaagaaatgaaggaagacatcttcaagtctgtagaaaactatcgtgatcacgttattgctgataaatggaggaaattgattaatgaactatgagttggtaagtgtcttacgaccagaaacggataactggaaatcccaaaaagaacgcgtagaaaaaaataatggaactttaattactttatttccggaaccacttttcgttcgtttgcgaaaagaagaatattccaagatgattaacattatcgattacgttactaaaagaaattacgacgaaaacagttcgctattttttgataaagtggataccgtacagggtgccgaaataattatgaatcgggacggcgtcattacaattgttaaagacggagtagtaattggagaaatgcgagttttcccccgcacccggcggttagtgcaagacatcaaattccttaatgtagatggcagtcgtgatatgattgaagaatatacctttgatggtaagcctttcagtaatattttttactatgatgataacgtccaagaaattgatttctttgataatgatcaaaatgttcggttacgttattacttgtacgaaggttcaattaacctgattacgattgaagatccgaaaactaaggaaattattgagaaatatgataacatgtcccaattccaagctgcgcaggtggctaagattattaaaccggaagatgaagtagggattacttatctaggtattgaattagatgctttaaaagacacgcaatctaaaaacaccctttacttagaggagtctgcctttgatggggaccaagtcaaggggaacctgaagttaattatggaagatgaaattgattacgttcaacacgtggtagtaagtagtgaagattaccagaaaatgcttgatttaggtttaaacgtttccaaagtcgaacctaaacaataaattaatgagtggtgcaatccttagttagtgaggaaggctcactcatttttttggttacttgaaaagtgagaaactaaggaatataataccggagacacaaatatatacgttaaggagaatgaaggatggctgagaaaaaaattaagattaacccgaatgaattcgctttggcagtaatcagcggctctaagttagataaccccgatgatgttcgcgcaagcaaggacgcactaaagcgttacttaacggcgtacatgttgattgaagaatttaacaaactagaagcaagccaatttaagttctttaagaaggcggatcgtgaaatgctggttaaggcgcttgaaggattacgcctcgactaaaaaagctaattgtttttgtttcaaagttctggagcagctgggaaaaactgaagattgcttttcaaggatgaaaagacttttaaaaagttgttttggtgatttaacttcaggagtgccaaaagtcagtttgttccgcgtaatctaaaattgaccatcatgcccaattcaggcatggtggtcaatttttagttaatgattgtaatttactcgtcctttgttccactttcttttggttttaaaacaacgggtcatttttacgagtttttttaatttcttggtgaatttttaaagcaattttatggttggtcttgattgctaccgacataaagagggcgtccacgatactcatctgcgcaattagtgcgtgaagagcttcggaacggtatagtgcttcttcagcaaccgaaattagggtaacgtccgccattttagctagggttgcgttggcagaactggtgattaaaattaagggaacttggtgttgcaacgctaatttagctaaggcaatcgcatcccggtcttcgcccgaatacgaaatcaaaagcattacgtccttagcagttagacgagttgctgccataatttgcatatgaaaatcatttgcgtaaaccacgtctagcggggttcgcaggaatttatgatagccatccagggcaacaatgttactagctcccagtccaaaaatgcccacctgctgggcgtctaataagagttgaacgcaggttgctaagtcagcttcgctaagggatttcaccgtggcttttaaagcatctgcgttagccgcaaaaaccttttcggcaacggtgactggcgaatcactaggactaatctctgcaaaaaggttatcggaattttcggtctgagcgagacttaactttagctcctgaaaatttttaaaccccaaatttttagcgaagcgtgaaatggtcgcggtagaaatcgcagttttttgacttagttcagaaatggtggcgtgactaatttgactttgattctttaaaagaaacgttgctaattggcgttctttatcgctgaagttgctttggcacgcctgaatacgtaacgcaaaatttgacattgtgtagatactcccatcaagtttacttatgttcagtatatcactaaatctagctcagaaaaataatttcatgaaagcgcttgatttatgtaaaatattttcatagaatggatatggaattaattatacgaagataagcgaggggttattatggaaattggattaatcggtttaggcaagatgggacttaacttagctaagaatatgcgtgaccaccaaattgaggtggttgcttttgatctatttgccgaggcgcgccaagcggcaaccaaggcccaaattaagacggttaccgatcttcaatctttagtaaagggactaacgcagccccgaatcgtttggtcaatgctaccagctggcaaacccactgacgatacaattaaagaactcagtgagttgctagacgaagacgacgtggtaattgacggtggaaattcgttttaccaagattcaattcgtcacgcggaaattttaaaggaacggggaattcacttctttgatgttggaacctcaggtggtaaagcaggggcccggcaaaatggtaactttatgattgggggacctcaagcaatctttgctcgaattgaacccctgtttaaagcgattgccgctgaagatggctacttgtacaccggtaaagcaggttcaggacattatttaaagatggtgcataatggaattgaatacggcatgatgcaagcaattggggaaggtttcgaagttttgagtgaaagtcaattttactatgataacgaagcggttgctaaagtttggaaccatggttcggtggtccgaagctggcttatggaactagcccaagatgcctttagtaaagatgctaacttagatgaaattaagggtgtaatgcatagctctggtgaaggagcatggacggtacaagaggcattacggctacgggtgcctactccggtaatttcgagtgcactgatgatgcgttaccgttcggaaaaagacgatacgatgaccggaaaggtagttgcggcattacgaaatgaattcggcggtcatgcagttgaccatcaggaaaaataggggatgaaacagatgaagtacatgattggtgttgatttggggaccaccagtaccaaggtagttttatttgatttaaagggaaaatcgattgcgtacgctaataatccatatcctttgtatcaagaaactccggacatggcggaagaggatccggaagaaatttttgacgcggtaatcagtggcttgacggaagtaatgcggaaaagccgggttgcggctgaccaaatttccggggtctcattttccagtgcgatgcacagtttgattttaatggatcaaaacgaccaaccgttaacccgggtgattacctgggcagacaaccgggctagccgggaagctgaagaacttaaggaaaacggcttaggtgctaagttatacgcgcgcaccggggtgcctacccatccaatgtcgccaatggttaagttactttggttaaaaaaagatcaaccagaattatttaaaaaagctaagcattttattggcattaaggactacgtattattccgcttatacggcaaatacgttcaagactattcactagccaacgcaactggtttgtttaacatttttgaaaaggattgggacagtttagccctagaaaccgttggaatcagtcgggaacaacttcctgagttagttaccccagaagaacaattagttgggatggaccgttcttacgcagaggtgaccggaatcaatcccgatacgccgtttattttaggagccagtgacggaaccttaagtaatctaggggtgaacgccattgatccaggagttttggcggtcacaattggtacctcgggcgcggtgcgggtagtggttgaccacccggtagtcgatccccgtggtcgcttgttcacctattaccttgacgataacaaatgggtagttggtggaccggtaaataatggcggaattgttttccggtgggttcgcgaccagctattttctccagaaaaaattactgcagaacagatgcaagttaactcgtacgaaattttaactgacattgccgctaagattcccgccggcgctgacgggttattattccacccgtacttaggtggcgaacgggcaccgatctgggacgctaacgcccggggcagtttctttggacttacgcggcaacatacccgagcacacatggttcgggctgcactagagggaattgtttataacctttacatggtcatgctgatgatcgaaggggttgcggggaaaccgaaatcaattcaagccaccggcggatttgcgcgaagcgaattatggcggcaaatgctagcggatattttcgagcaagacgttaacattccggaaagttttgaaagttcagcacttggagcggttgtaatcggaatgaagagtttgggaattattgacgacctcagtgccgttaaatcaatggtgggggttacacaccaacaccatcctaaccaagaaaacttcggggtttaccgggaactactaccaatttggatccggttgacggacgaattagcaggcgaatatgacagcattgcggacttccagcgcaaacaccctaaccctcacgcgcgaattgcggaagaagattaattgccaaggtagggccgtaatttagtcagaaattttaaaaagtagcaatcgtaagctaccagcaccgcgattcaaaaaactggagactgaatgaactattgtaaataggaagcttttcagtctcctgtatttttgaaaaagcatgcaaccgcttacctagtgctgataaggagtgaaaacaatggagtttatagttctaattgttggaattattttattactcactttaattattaagtttaaatttaacacatacgtttcattgatcgttacgtcagtagtcgtgggactgggactaggaatgcccgcaagtaaaatcgcagacaccattcaaaacgggattggtagtcagctgggcgaattagcactggtctttggttttggggcaatgttaggacggttagttgccaacgcaggcggtgcttatcgcattgcccataccttaattaataagtttggccggcgtttcttgcaaatggcggtagtagtggcttcctttattattgggattgcgttgttcttcgaagtcggcattgtactcttagttccaattgtgtttgcaatcgctactgaagccggggtttcagttctcgcgctagggattccaatggcaacggctttatcagttacccacgggtttttaccaccccatccagcaccaaccgcaattgcggcagttttgaatgctaacgcgggtaaggtactgctttacggaattatcgtggccattccaacggtttacgttgcgggaattttatttactaaggttgcacgtaaaatggtgccaagcgcttttgaacggacgggtaatttaaaggctttgggtccccaaaaggaatttaagttgtcagagacgccaagttttggaatggcggtgttaacctcgctatttccagtaattttgatggccatcacaacgatttatgacctggtggttcacaacggggtcactcctacacatccaaacttcttggacaacttaattagtttcatcggttcgccaagtattgcaatgttaatttccttattattcgcaatttggtcaatgggttatcaccgtaacattcctagtggtgagattatgagtactttagaagacgcggtaaagtcaatcgcgatgttactcctcgtaattggcgggggcggtgccttcaagcaagttttgattgacgggggagtgggcgacgccattaaaacggcgtttgcttcttcaagcatttcaccattaattttaggttggctaattgccgtgattttgcgggtggcactaggatcagctaccgtttcagctctcaccgcggcaggtttggtactacctttgatgcaaggagcgggaatcgatcccgcactgatggtcctttctgttggagcaggtagtttagcagctagtcatgttaatgattctggattttggatgtttaaagagtattttgatttaaccgttaaggaaaccctcctaacgtggacgatgctcgaaacggtaatttccgtagtaggcttagcaggagtcttagttctgagtttagtggtataacgcgattacagatggtactcacgttgaaaaataattacaatctaaaaaaataatttaataggtagaaaaattaaaggatttggttaaaaatggccaagtccttttaatttgcgtcaagccgactatttacatcaacaaagggtgtttagcaaaaaatcgtcatattgttggagactactatataggaaagaaagtttttgataagatggattttagagttaaaaactacgttattacggaacaatcaacgtaatttaataatccaaagaacggtggacaatttatttaggatacagtagtaaagttaggggagtaggcatgaagctttttaagcgcatcatcaaatatttactaatcttaattgggggagctggcttagcgattgttattgcaattaacgtttctccgagaccattcgtcttctttttaaatcacgctgcaaaagacgaagctgcaattaggccacgcgcgtatcagagttaccgggatcagatttccattaaaaaggatgtcagatattcatcgcaatccgctaaaaacaccatggatattttctataaaaaggataaccgtactaaaccaacggttatttgggcgcacgggggcgcctttgttgctggcgataagtcgggaaccacttactgggctactaaaatggcggcaaatgggtataacgtcgtgtcaattaactatccgcttgctccggatcgccagtatcccacccaagtgaaccagatgcgggaagccattcaattcgtgcatcgtaactatgcaaaacaattaaatgtgcaaaaagtagtggtcggtggtgattcagctggggcccacattacgtctcaagtaattgctgcgcagtataaccatcagctagctactgcaataaattatcaccatttgagggatgtaaaaattgttggcggattattatactgtgggccgtatgatattaaacaaatggtaaataaaaagcacgtagataccatgacgaaactttttgttaatcaagtcggctgggcatacctaggcgacaaggattggaaaaattcggcaaaggggcggctggtttccacggtgaattacgtgaataagcaattcccaccgatctttattacagatggtaataatggatcttttgaagcccaaggaaaagagctataccataaattacgtgaagaaggagtggctacgcaggcgttatttttcggtaaagaacgaaaagttaaccatgaataccagtttgatttggatagccgggctggtaaagaatgtttcgaggatacacaagattttttaaaaaacttagattagctggtggacctgattagccagcgaccgtctaatgcaatataaatggacaatggatacaaggtttagtaccgtgacgtctgataaattagagcgacttttcaaggatttttaacttcttgggaagtcttttttggttctctaccacgttttttataaaaatccgcctaggaagtcttgtacagaaaacggtttatttatggggatttaggagaaaaaaggcagaatcaaggctttttgcaaaaaaaatatttcattttgcaaatatctctgaaaggatggaatcctaatttattgggggatgacggagcttttattacaaaatgttacagaatcttacaaaatatccctatttcccaaaatatcccaatatgtttgtaatataggttcggtaaagtaataacctgttgaaacgaaagaaacacggacatgattttttaaacataaaggagatatttaatctatatgtcaatcaaaagtaaattttcaaaactatctattgctttacttgcgggtgcagcaatcggtgcaacggcaattacaagtggtagtgcaaatgcggacgaaatttacactgtaaaatctggtgacactctttcagaaatcagctacgcgtttaaccttaacggtaactacgatgcaatcgcgcaagctaaccacattaaagacgttaacttcatcacggttggtcaaaaattagtaattaaggataacggaagcattcaaaaggctactaagtcagaaattaagtcgcttccagaagttgataaagatactaatgctgcagcagctactaagcaagcaactcctgctaagactgctacaccaaaggcaacttctactaaaacagcaagttacagtggaaacagctcagtatcttcagttgctaacgaaatggcatcccggacgggagtttctgctgctaagtggcaacaaattatcatgcgtgaatctggcgggaacgctaacgtatctaacgcttcttccggagcttacggtttgttccaattactaggtcacggtgaacatgctggaatgtcagttgctgaacaaatcaacatggcaactaacgtttataacgcacaaggtttatcagcttggggagaataagctgataaatatcggatcttaaaaaataatatttcatttttgacaattaacccaagcgtaaaaaagcagtgatagcaaggctaacgggtcggtttgttacaaaatgttacttgactttacaaaatttcagtgatttatcagaatttgaaaatagttctgtaataatcatcgtgtaaagttactgatgttgaaacaaagaagaagaaaaaagtgtttttaaaaataaggagaaataattaaatgtcaattaaaagtaaaatttctaaaatgtcaatcgcattactttctggtgccgcaattggtgctgctatgattactaccagtggtagtgctagcgctgatgaaatttacacagtaaaatctggcgatacactctcagaaattagttactcatttggcttgaacggtgattacaacaccattgctaaggctaacaacattgctgacgtaaacgtaatttacgttggtcaaaagttgaagatcactaacgatggtgacattaagcaagctacaaacaaagatgttcaacaacttcctgaagtaaagcaaaacacaaatgctgctggctcaagccaagcacaaacaacacaaactcaagcacaaacacaaactagccaagcatctgttcaaaaggctgctccagttcgtcaagcaagcacaactaacaacaatagctcatactcatcaaacgcaactggcaacgaagctgctgctaaagcttggatcgcggcacgcgaatcaggtgggtcatacacagctcgtaacggtcaatacattggtaagtatcaattatcttcatcatacttaaatggtgactactccgcagctaaccaagaacgcgttgctgacaattacgttaagtcacgttacggtagctggagtgctgctaagaacgcttgggtatcacaaggttggtactaaaataaaaatatttatacgttaaaaactgggaaaatagtcccaaaccatggcagagaccagaatttcgtaaattctggtctctgttttcgtttagaagtggaaacctggttatcaaagaagacacctcaatgctgagatagtaatggttgctggctgtacccagaaaaaacaattttaaaataacccgttaggagatgcgtggatggataagggatacggtgttaaacttgcgtactacgaatcgctgttggaaaatagctacgcggaggcggtagccaagttaaaagaaaagtatggaacggtggaggacgactattttcgcgagaagtcttatgaacggtttttgaatgggaaaataaaattcccagaaaaagggaatttttcaaaaacagcgttaggtttatattgtcatcacgtaaatgaaaaccaccatgagcatttagcggatctagaatggataaaaaaatatcagtactcctttgaactccagcaaaaagaacaactagtttattgcgatctattcgaacacttgcttttgcaggcgctaattatgaaagaaactggtaatcagtttggagaagcggagtttcgggtgttcttagcgccggatattattaacttttattcgagaaaattggaaccaaaaacaaaatggaaaaaggtaattaaacaaagggcatttttacctagcgaggaaaccgagcaacttttagataaggtaatggggtttttagggacggtgtaaggttttcgaaatagcattactcgattgataaacggtgcaaggctattttgaatagtaacgctcgtaattaagaattaaatttaaccaataatcactaacgaaaattatgacgaaattatgtgtcaattaatgtttagagcaagcatgatcgtcagcaaatttaataattgcagagggagacaaaagccaggggagtttgtgagcactagctaaaacatcgatcattatgccgaatttgggtataatggtcgatttttagttaagcggaataaactgccctttgacgcaagtctgggcgttattaaagccaaaacggtaaaataatttttttgaaaatttttgtccttgaaaggatttttagctttttataatttggtcgggattctaaaaagaaaatgcagtggagaacggtttagtaagccgtctaatatagtagtttaacgataatgcctgtattcggacggtttgcttcaattgaagccttacatggtctaactaccaagttggcgggggcgcccactcgttgaacgttaaaagcgacttttttaaggtgtttttgcgcctttgatttcgttattataaaaggggggacgaccaaagctaagggtctttttccgtatttttcataaatttttcgattaaaaagactatactgggtgatgtaaatgaaattggaggaatttcaatgcagatattaatgattgaagataataaatcagtttccgatatgatggggatgtttttcaagaaggaaaagtggaaagttacttttgcttatgacggagtcaaggcgttagaaatttttaaggcggatccgcaacagtgggacattgttttgttggacttaaatttaccgggaaaagatggaatggaagtggcggccgaattacggcgaacttcacatacggtgccgctaattatgttgactgctcgagactctgaaagcgaccaagtattagggttagaaatgggagcagatgagtacattactaaaccatttagtccaattactctgattgcaaggattaaggcgttacatcgccgggtcttgatgaataagcacaataataatgcggagcaacaggctggtaaattcgacgtgcggacggcgcacttaaagattagcacggcgacccgcgaagtctacctagatggaaaattaatttcagatttgacgccgaaggaatttgatctactaaaaactttggcacaaaagccaatgcaagttttctcccgggagcaattattacaaatggtgtgggattacgagtattatggtgatgaacgaaccgtggatgctcacattaaaaaacttcggcaaaaacttgaggcagtaggtccacaagtagtgcaaacggtttggggcgttggttacaaatttgatgatagtaaaattgacgagggataactaatgaagttgttttttcaacaaatgatggccttcttagcggtaaccgtggcgacgctactaattgttgggttagtatttattcaatttacacgtgattcagtttaccgcactaagtggcattctctgcaagaatatgcggatagcattttccagcagttggtagtccttgacccgcaagattcgtcggtgacgaccgttcgggtagatcaattgatggggatggagcgcttattaaacaatcagcacattcatttcaccatttatacggaaaatggcgaacgggttagctatcctaatgacaataccgcgacgcaaatcagtaaaaaacagtggcgggagttgaacaagggcaatattcttcgtcaagaatcccgaatggcggtcgggcaggtaaaacatcgaatcaccatgacggagcttaaaaaaccgtattttgaccgtcaaggaaagctaatttgtgtgattgcggtaggctctcccttggcaaatgttcaggctgatattcaacaggtacagaagaacttgttagtcacgtttggcttagcaatcctggtagcaattgtggcttcctatttcctatcccggtacatggttcgccggattcaaaagattcgtcaggcagctcaccgagttaccgaaggggattttgaggtgcagctggatcctggtcgacaggacgaaattggcgagttaagtgccgattttaacttaatgactaagtcacttaaagaatctaatgatgaaattaagcgtcaagaagaacgacggcgagcttttatggcggatgcggctcatgaaatgcgaacaccgttaacgacaattaacggcctcttagagggcttagaatacgatgccattccggaagatagtaaggaagaaagcattcgactgatgcaaagggaaactaagcgattgattcgattggttaacgacaacttagattatgaacgaattcgcaccaataaaattaaactagactgccagatggttaacttgaagcaagctgttctccgcgtggtagaacagctgggcaaaaaagcggaaaaggaaaatgaccagcttatagtagagatgaatagtgacgtggtggtgtacgcagatcccgaccggttgattcaaattctattcaacattgtgcaaaacgggattcaatttacccaaaacggccaaattacggtgcgtgcgcagaatgcaagtaacggaaccaatattcaaattagtgataacgggattggaatgaccgaggatcaaattaaaaatatttgggaacggtactacaaagcagatgcttcgcggatccagacgaaaggtgaatctggtttagggatggcaattgtgcatgaactagtccaaattcacggcggtgaaattgaagtctcgagcgcgccaggccggggaaccacctttaaactgcattttcctaaagctcccgcagatcaataggggggtggattataaatatagagtacgttgcgacatcgttaaaggcaatatactaaggagttggcgagaatctttaggttcttggacaacgccttttatttttgctgccatttagttaaacagtggagcttgatttttgcgacaaagaaaaaagcctgacggataaatccgccaagctttttaattaaaggcttatttttaccacattgaaggagtattgaaccattcaatacgttccttaacagtgttcttgatagcttctgtaccagaagcaagaaccttacgagggtcaaatcctttaggcttcttgtcattgtcttcttcgtagtacttacgaacagcttctgaccaagcaatttgttgttcagtattaacgttaacttttgaaatacccattgaaattgccttaacaatttgttccttaggaattcctgaaccaccgtgcaatacaagtggtgtgtcgatagcgtcagctaattcttgaagacgatcgaagttcaaacctttccagttttcagggtaaacaccgtggatgttaccaataccaacggcaaggtagtcaacacctgtagctgcaagtgtcttagcttcttcaacgtcagctaattcaccagcaccgatgattccgtcttcttcaccaccgattgaaccaacttcagcttcaacagaaataccttgagcatgtgccaaagcaacgatttcttttgtcttaaccaagttttcttcgaagtcaaggtcatgaccgtcaaacataactgagctgtatccagcagcgatagcttccttagcagcttcgtagttaccatggtctaagtgcatgataactggaacggtgatgcccattgattctacttcgctttcaacaagacgcttaacggccttgtagccacccatgtacttagcagcacccattgatgattgaatcaagattggtgtgtgtgtttcttgacctgctgctagaatagcacgagtccattcaaggttatttgtgttgaaagcacctacagcatagtggcccttacgagcagctgcaaatgtttctgtaccattaataaatgacataaaactggttcctcccaatatttttatacagacaaagagttctcctcttcgcaacacttctattctagcacaaaaccttaaaattttatacgagttttcataaaactacttgattacttttaatgtatctaatggttattttcataacgagtttcaaaaaaatggaaaatgaagtataccattttaatttcaaaaaaatgttggaattcgttttcataactggtataataatattttgtcttatgagagagacagagattgataaatatataggagatattgatatgaatattttactcgctttggttcccgcaattatgtggggaagtattggtttagtgagtggccgcttaggcgggagtgcgtcgcagcaaacgttaggaatgacgatgggtgcggtgattttctccttagtgaccctcgtgatttaccagccaacgttaaacggtaagatttggattgctggtttgatttctggccttttttgggcagttgggcaatttaaccagtttagttcaatgaagcacattggggtttctaagacagtgccaatttcaaccggcttacagttggcagggaacgcccttgcaggggtactgatttggcacgaatggacttccggtaatatgatcatggttggtaccatcgcggtaatcgctttaatcgttggtgcggcattaacgtcactaaaagataagagcgattccacgacggaaaacgatgacgaaaatatgccagccggaattcaagcgctgacaatttcgacgattgggtacatcggttatacggtaatcgtacgttttgcaaatgttgatgcgaaggcaattattttcccacaagcagttggaatgttgctcggagctttcttgtttgttttctttgctaaagaaacggatcaaattgcaaagaaaccaacgttcttaaacattactactggtttaatttggggaatcgggaacatcttcatgttcttggcaattccatcagttggactagcaattagctactccttagcacaggctggaattgtaatttctactttcggatcaatttggttactaggtgaacgtaagacccatcgcgaaatgcagttcgtgattatcggctcgattttaattattatcggtgaaacgttactagcaacgttaaaatagaaatcttaatatgaagaaaacagactgggattttaaaatccgcggtctttttttatgcaatcatataaagatatgaggagtttttgcgtagaatccgataaaaaatatagaccaattttctttagaaaaacttaatttttaaagtgacttgctgacaggcgctaatttgtttaaggaaaatttaaccgcttcaagttgtccaaagttcttcaaagtctggcaaactattgtataatagtagggaattctaaataaaaggggtatttaaaatggcacacatttcatttgatagttccaacgtggctgatttcgttcatgaaaatgaacttgctgaaatccaaccaatggttaccgctgccgacgaattagttcgcaaaggtactggtgcaggaagcgacttccggggctggttagacttaccatctaactacgataaggaagaattcgcacggattaagaaagctgctgaaaagattcgcgaagactccgaagtctttgttgcaatcggaattggtggctcatatttgggagcccgtgccgcaattgatttcttaaacaacacgttctacaacatgttgactaaggaacaacgtaacggtgcacctcaagtaatttttgctggtaactcaattagttccacataccttgcagacgttttgaacttgattggtgaccgtgacttctcgatcaacgtaatttctaagtcgggtacaactaccgaacctgcaattgctttccgcgttttgaaggaaaaattgattgcaaaatacggtgaagaagaagctaagaaacggatctacgctacaactgaccgtgccaaaggtgctttgaagactgaagcagatgctgaaggatacgaagaatttgttgtgcctgatgacatcgggggacgtttctcagtactttctgcagttggtttacttccaattgccgtagctggtggcgacatcgatcaattaatgaagggtgccgaagacgcaagcaaggaatacacagatgctgacgttaacaaaaacgacgcatacaagtatgccgcattgcggaacatcctttaccggaagggttacactaccgaattgcttgaaaactacgaaccaacgttacaatactttggcgaatggtggaagcaattgatgggtgaatccgaaggtaaggaccaaaagggcatttatccttcatcagcaaacttttcaactgatttacactcacttggacaatacatccaagaaggtcgtcgcgacttgatggaaactgtaattaacgttgaaaagccaaaccatgacatcgacattcctaaggaagcagaaaaccttgatggtctccgttacctagaaggtcggacaatggacgaagttaataagaaagcttaccaaggggttacccttgcgcacaacgatggtggcgttccagtaatgacgcttaacatccctgaccaaactgcttacacgcttggttacatgatttacttctttgaagcagccgttgccgtttctggttacttgaacggaatcaacccattcaaccaaccaggtgttgaagcatacaagtccaacatgtttgctttacttggtaaaccaggttacgaagacaagactgaagaattaaacgctcgtttaaaataattttaaactaggctaatatttaaaaatcctgatcgcaatttaaaaattgtggtcaggattttttatttacagttttaatttgctaaacagctgttgatatcgtagaaaacgcggacttttaagcagaatcttagttaaaatggtgcccactaagccgccaaaaagggtcgcagcgaggaaacgcggagtgtaaatgaaccaatacaagccgttactactgccggtgaataaaatcatgaccggatagcttagcagggagccaataattccggtaccgatgatttcccctagccaagcgccgccgacccggttagtccaccggtaaaagagggcggaaagaacgccaccaaatactgcgccagttaaggcgagcgggggaattcccagaatgagcatccgaattattccggtcattaaagtgattgcgaatgcgtaaaaggggccgactaaacagccaatgattacgtttagcacgctcgacatgggagccattccttcaatccgaaaaagcggagaagtaactacgtcgatggcaatcagtaaagcagcgatggccagtcgtaaagtggttttattttgcatggtaattcctccaaaatcaattttagctaggggtgctgcttaaaaagcccagttaaaaagcggtctcccgcaaagcaggacaccgctggttacataaaattagtaaaaacacaattatatgtagcttggctaatgcactgctccctgcgctaatcctaattagatcaggttcaatgggtatgatctcagccgcgtggcaccccagcaatgttagtagttatttgctgaccaagataccacgttttttaaactttgtaaatggggttaactttatgaagaatcgaattcgttaaaaaaatgggttaagcgtttacattaggagtcgtataatggtaatgaagtgtaaagcggtttgatagacaaagctaatttggaggaggttagcgaaatgaaacaactcgttgcgatagtggggactaacgcacggcatccatccttttttggataaaccggtaatgattacggctgcctcttacggtaatttgggcgcctcaagagcgcatgcccagctccggcaaattttagacgcaccggaactgaaggcccgtattttgcctagttctgaatttttgttggggaattctttacaagcatttgatgaacgcggtgatttaattgatcaaactaaggttgcccagctagatggtttgtttgccgattttttggcgtttttagagattgcccagcagttaaaccatgctcatcaagctaatgaaaccgaattaaggcaatttgtgcaacaaaatgatgatagtcctcgagaaggggtgtgatagaatgaaactcgtggcaattgccggatcgattggcgaacaatcatataaccgaatgttagtggaatatttacggcgacattttcaaaaaatcgtaacaattgaagtactagatctgcgggaagttcccgtatttaacgaggatcaagacctaagcgcatccccagttttacaggagctaaaccaaaaaattaaggcggcagacggggtgattttagccatcccagaacataaccataccattcccgcagctatgaaaaacctcattgaatggttttcgtttaaattacacccgtttgatgggaaaccgatctgggtgattggggcgtcgtattataaccaagggacttcccgcgcccaattgcacctgaaacagatcctagaggcaccgcacgtcaatgggatcgttatgccgggcaatgagtttttgctaagtaatgcaaaaacagctttcaatgaagccggtgatttacgggatgcaaaaacagtggcttttcttgaacaaattttgcaaaagtttcttaaatttgtgcgggtgattgaacaacttgagtagcttttgcgcttgggatccagtattaaagtttattgagtaggagtttagattaaatgaatcaaaattggcaaaagccttccccgaaactaaattgggtgcgattttattcgatagtaaccattctggtcttggtaactagcgtagcgggcttagaaatgttacgggttagcgcacaccaagaagttgcgcaatcacaatcgcaacgcggcccagtaaacaaaaagggttcggctaagcatcaacccgcgacaaacccacaagttccaatgaagaaagccgtcaataaagcgaccgctaagggatttgctgaacaattacgtccgtttttagcgaacacaaatgcaaaggttgcggttgcggtgtattcaaaacgggaccatcagctttatgaggcaactaataccaagcagactactttcccttcggcaagtattattaaaaccgaccttttagtagaactgttgcatcagcgtcaccaaaaagccagcgctttaaccaccggagagcaaaacgcgacggtacagatgattgaaaatagtgataacaatgcggccacgagtatttacaatgatatcggcagcgcgcgaggtttggggcaattgtttaacaacttaaaaatgactaactcgactgcgttagcaagtgggtgggcgctgacacccaccaccccccgtgaccaaattaaggtgttaaacaagattttttacgagaacggctatatctcaaataagtcaaaggcctatactaaaaatttgatggctaacgttgccgacgaccaagactggggaatttcagcaggttccaagtatgcttggctaaagaatggttggaaacagatgcctaacgggcactggattgttaacagcattggttacttaggcaagggcgagaacagttgcaccattgcaatcatgtcagaagataacccttctttggaaagcggagaggcgttattagaaaagttaagtcaacaagttggcgttcagctaaaaattgcgggagctgaacggaaggtttagaaagcgaaaataaaatccgttggcattaagcgtgtaaactaaatgccaacggatttttttgtgatcaaacaaaaaagctgtcatcctcgcatcttgagaatgacagctttttaaatgattggccatactgggttcgaaccagtaaattacggattcagagtccgctgccttaccaatttggcgaatggccaataaatcacccgcacggggatcgaacccgtaactccggcttgagaggccgacgtcttaaccaatttgaccagcgggcaaattactatattaatttacactaaatttttcatttcgtcaataaactaagcgaaaaatggttaattaattgctaaaatttccacctgatattgctcatcgggggcgttgaccgtcaccacgtcatgaaggtggtggtgtagtagggcagcgcctagcggagattgataagaaactttttgctgggccacgtcggcttcgtgtttacccacgatttcgtaagtgacagtgaaatcgtcatccaaaaatcggagagtgacgttgctgccgaggtcaattttagaacggtccgcgttttccacaatcttggagtagttaatttgccgttccagataccgcaagcgcccttccattcggcgtaaatcccgtttggctgtactatattccgcattttcggataaatcacccagtgcgcgggcgtccgctaacgccttaattaagctggggcgggtcttttttaaatcagcaatctcttgttgaatcttttgatatccggttttagtcatcggtacgaattgggggtgcatatgctcaggtcctttacattggtgaagattcaaaagttagttcgatcatgtattcgtgttggtcaacaatgtgcgaagtggtgacccaaactgaatcaagtccgtgatcaagtgcttcagttttagcaaggaaccgccccaataatgccccgtttttggccacaaaatcatcagcgaagcggtccactagcaaactattatccgggaaataaacctccggattagcgacgggggtgctatctgggaaagtcatgtttaaaacgtttcggtaacctagcggattgatccgcgccatttcaggtttgttatcgatccggtataaaacattgtacaaagaatcagaattggtggccataataagttcctttctgtaacggttatttttcggtttaaagttgttgcaattcgcgtattccagtgtataatagctgtttatgacaagttgtcatttttggggggtgcaacatgccaaaacaaactttctttaatttaaaggatgaaaagcagcgccgaattatcgcggcggcgcgacgtgaatttagtcaccaccctttatatgaaagctccatcaacaatatcattaaagaggctaaaattccccgggggagtttttaccaatattttgaggatattgctgatttatatggctattattttagtttgattttggaagatattcaagcgagactcattgacgaggttcgccaaaatcacggagacatttttgctgcggtgcgaaagtacgcgggcgtttttttggaagagatccttgcgggcgaacaccgcgatttctaccggaatttctttttgggagctaacgcttcgattcgcgcccgggaaaatcaccatcccggaaccggatttaacgtcttccactccaaacggatgcgggaattgcgttcccaattgcgggaggtagtcgactgggatcaattaaaagttaccagtcaaaaggaccaagccatgattcaacagttgatcatgatgattttctttcatgcatttgctagttattttatccacgctgatgaaacggatgaagaacctgctatggtgcaaaaagaaattgaacataacttggattggctagaatatggcgtaagaagaacggaggaaaagtagtttatgtggaaaatattgaaaaaacggttaagctggggagctgttttaatcggcaccgtctttttggtcgttcaaattgttggcgatttaattttaccaaacatcacctcggatattatcaataacggggtcgctaagaacaatatcgactacatttggaactcaggatttaaaatgttaggcgtttccctgatcgggttaattggggccgcggtgaacgtgtattttgccgcaacccaggcgcaaaaggttggcaataagttgaggagttctttatttaaaaagatttccttcatgtctaactatgaattcgaacggtttggggaagcttcgctaattacccggaccactaacgacgttattcaaattcaaaacgtagtggtaatgattttacgaatgatgctgatgtcgccaattatgttggtgggcgccggcttcatggcttaccagaaacaatcggaattaacgggcgtcttcctcattgcgttaccggtgctggcaatttttgtgggcctggtaatgtacttcgcggttccgctctttaaaggattacagaaaaagattgaccggattaacttggtttttcgggaaggcttaaccggggtgcgggtaatccgggcgttcaaccaagaccaatttgaacaagaccggtttgccgatgccaaccatgattacatgcgtaccgggattaaggtatttaccatcgtttcgttcatgtttccaatcatgacgttaatcatgagcggaactaacattggaatcgtttggtacggggcgcacttaattgccgatcggacgatggaagttggtaacctagtggccttcatgacgtacgccacccaaattttaatgagttttatgatgctttcgatggttttcgtgatgattccgcgagcttctgcttcagcagcccggatcaacgaagttttggaaacccaaaacagcgttaccgacgagaccactacgacggatttaccagcccaacccgcaactacgctagcttataagaacgtagaattccgttatcctggcgcagaacgcctttcgattgacaacgccaatttccaagctaaggctggcgataccgtggcaatcattgggggaactggttcaggaaagacaaccttgattagtttactaccacggttgtttgacgtgacggcaggaaaggtggagttggacggagttgatatccgccagctcagccaacacgcattgcacgaacaaattgcctttgcacaacaaaaggccttgctcttcaagggaacgattcgtgaaaatatgcgttacggtaatccaaaggcaaccgacgaagaaatttggcacgctttagaagtagcccaagcaaccgaatttattagtcgggatggcgatggattggatacttttgtagaacaaaacggggataatttttccggtgggcaaaagcaacggttgtcgattgcccgtacgttggttaaaaaggcccaagtttacgtgtttgatgattcattttcagcactcgatttcaagaccgacgctaacttacggaaggcgttacgcgaagacccagaaattcaaaaggggattgtgattatcgtggcccaacggattgcaacggttgcggatgctgacttaatcctcgtcttggacggcggaaaggttgttggtcaaggaacgcatgctgaattgaaggctaataacgaaacctatagagaaattattgattcccaaatcaagaaaggagaccaagcaaatggctaaaccaacaaaaccagtaaacgcacctcgtcctggacgacatggcggtcccggtggggtaattgaaaaaccgcagaacttttggaaatcagcggttcggttagcaaagtatttatctccttggatgttcggcttcatcatcgtgttgatccttgcagccctatccaccctattgcaaattcgggcaccaaaagttttaggggaggccactaccgaaatttttaagggcgtgatgaagggcgctatgaaaatgaagatggggatgcccgttcatcattttccggttaactttgataaggtcttccaaatcttggttacggtaggaattctttacggactctccgcagccttcagctttattcaacaagtggtaatgacccgggtttcgcaaaaggcagttgcccaattgcggagcgattttaaagacaagatgcaaaaattaccgatttcatactatgatacccattcaaacggggacatcatgagtcggatgactaacgatatggataatatcagttccacactgcaacaaagtttgacccagttggtcacgagtgctttgcaattcgtcggtgttttgtacatgatgctgacgattagttggaaattgactttagtagccgtggctaccgttccattaagtttgattgtggtaacgatcgttgctcctaagtcacaacgttacttcaagtcccaacaaaagcatctgggattaatgaacgaccaggttgaagaaacttatgccggacacacggtaattaaaacttacaaccacgagcaaaaggccattgaagattttgaaaaagaaaacgttaagtattatcggtcagcttggaaggcacaatttattagcggattgattatgccgttaatgaactttgttaagaacctgggttacttgatggtcgccgtcctaggtggcgttcaggttgctcacggaaggttatcattaggtaacgtacaagcattcctgcaatacacacaacagttttcccaaccgattactcaagtggccaacattgccaataccttgcaaatgaccatggcatctgcagaacgggtctttgaagtactggatcaacctgaaatggaagaaacccatacggacgttgccaaggttgatacaagtgctaaggtaattattgatgacgttgatttccgttacgtgccggacaaaccgttgatccgtaactttaacttgcgggttgaaccgggtgaaatggtcgcaattgttggaccaaccggagctggaaaaactaccatcattaacctgttagaacgtttttacgacgttaattccggaaccatttatttagatggagaagatactcgtaacatgtcccgcaacgagttacggaaacacattgccatggtattgcaagatacctggttgtttaccggaaccattcgggaaaatattaagtatggccgggaaggggctactgacgaagaaatgtacgcggcagccaaagcagcccacgcggacggcttcatccgccaattaccagacggctatgacacggtcttaaatgaggcggcatctaacatttcgcaaggacagcgacaattactaacgattgcccgcgcgttcttagcagaccctgacatcttgattttagatgaagcaactagttcggtagatacccggactgaagtgctaattcaaaaggcgatgaaccggttgttgaagaaccggaccagtttcgtggttgcgcaccgactttcgaccatccgaaatgcccaaaacatcgtggtcatgaaccatggacagattgtggaaactggtaaccatgacggcttaatggcccaaaatggcttctacgctgatttatataattcacagtttgccagtggtgaagtgatttaatttgcccaggtaaaattaaactaggtcgcggccgacataaccaaaatgattcgtgttcggatgcgttttggcttcgttaacgtaaaacgactataaaggcatttcaagaatttttagattcttgaagtgcctttttattttctccgacgtttttcttgtagaaagtaggatataattcaaggggaaatttagtttggaaaaaagcgggggataaaatgagctttgaaaaaacgcgagcgttaattgccgaaatgcttgagcgacaaatcattcctggagtggactatacgctaattcagcacggaaaagttaagtatacggtaacgcaaggaactgaaacgggggctccaggtgcgcgaaggttaactgaagattgttattttgatttagcgtcgctgaccaaggtgattgggacggtgccgctgattttgcagttagcggcggaaaaacaattggaacttgatggatcggtaaatacatacttaccagaaattaaggactcccgggttaccatccggcacttattaacgcacacgtcgggagtcaccgcgtggattgatcaccgggatgacttgtccgccagtcaactgcgcgaagccatttacgcccaagttagttttgggacgaagttcaaccaagaaattgaatacaacgattataattaccttttactgggcttcattgcggaaaaaataacccatctgccagttcaaaaggcaatccagcaattagttttaatgccgtggcagctcacccagagcacgttcaacccggatccgttccaaacggtgccgacgggaattcgggatggcgtcttattacgcggacaagttcatgacccaaaagccgcctccctgggagcacatgccgcctcggcagggttgtttgcaaccaaggctgacgtagttaaattcacccaaaaaatgcttgcgccccaaaacgaactgtttgggattaaccaacagcaggtttttttagataatcagactgctaatccagcgttacaacgctcgtggggctgggcgtttgtttgccacaatgctgaccaagtggtgttgcggcatagcggatttaccgggacgtttatcttatgggaccgaatgacccaaaatgcgttagtactgttgtccaaccggctttatccagaacctaacttagaatttttggattatcgccaacaaatttatcaaacttttgcggcagaagataaattaaagtaagggcttaaagataaaaaggggttatggtattcttattattgagtgaatgaaaggggttttataaactatgagcgaaccattatttttgaacccggttttccatgagaaaatttggggcggcgaccatttgaagactaagtttggttatgatattcctagtgaccacaccggtgaatgttgggcaatttctgcccatccacacggacctgccgcaattgcgaacggtgaatttaaggggatgacactcgatcaattatgggaccagcatcgcgaacagtttggcaatgccaagggcgatgtctttcctttattaacgaaaattttagatgctaaccaagacttgtccttgcaggtccatccggacgatgcttacgctgccgaacacgaacatgaattgggcaagactgaatgctggtacattatttcagctgaaccaggggctgaattatactacggacataatgcgcaaactcgcgaagaacttgccgactggattaaccatggtaaatgggataaattattccgcaaagttccggttaaagcgggcgaattttactacgtacctagcggaaccattcatgcgttgggcaagggcattatggtactagaaacccaacaaagcagtgacaccacttaccggttgtacgattttgaccgggtggataagacgactggtaagaaacgtgagctacacttacaacagtccatcgacgttactaacgtgcctcatcacgatccccaattaaacattaccaatgaacaagttggggatgctcaagtaaccacctttgtgcaaccgccagtatcgaagtatttctcggttaaacgggtggaactacatgatggtagcgcagaattcaaccgggaaggtttgtacaccttagtttcggtgttagacggtgaaggaacgctcacggtggatggtcaagactatccaattaagaaggggcaacacttcattttaccgaacccagttaagcagtggcgttatcaaggcagcttagaattaatcgttagcgagcctggcgaagaatagtaaaaatagttattgaactataaataaaaagagtaggaaaggtaatcacgcggttactcttcctactctttttaatatttgatgttaaaaggttggttcaatttttaatgcttcctgggcgcttaaatcagcatcagggtaacgccggtgtaacgctgtcaggagaattcgcttggcgaggtttccgtttctagtaagaatcgggccgtggaaatacgaaccgtaaacatttttgtagataacgccttccgattcgtcttcaccgttatttccgtttccggtgaccacttttcctaggggacgttcgtccttacctagataagttttaccgttgtggttttcaaatccgtggtaagtttcgccagtttcctggtttttaattacgatatcgccaatgaaccggttatcatcttggctcaatgtgtagtgatctaaggcaccaatcccgctaattttttcaccgtttgcgcctacgtaatagtgaccaaggagttggtagcctccacagattgctagaagaggaccgccatcttcaatatagctggtcagctccgcctttttattttgtaagtctcgggaaacgatggtttgttcgtaatcttgaccgccaccgaagaaaacgatgtcccaatccttagcgacaaactggtcgtcaaggctaacgatttggatgtctaacttagtgtccatcattttagcgtagtagttaagggctaataaattgccgttatccccgtaggtattaagcaaatcaccatataaatgggcgacttttaattcgtatttcataattaaaccccctccttaatatagccatcactaattagttgcttacgtagttgtaacatggccgtgtaggttgcaaaaacgtaaacccgggtagtagggagccttttaatatttgcaatcgcgtcgggcaagttatcgtaagtccaaagttggtcatcagtgacgccagccaccttcaaacggaaggtaatgtctttgtaccgctcgccaccggtgatgtattgttgaatgttcatttgtgctaatttttcgaaattaccgtcccaaatccagcttgtatcaattccgtcggcatagttggcgtttaaaagacccacaaaggagaacggctcggtttcggtacccaccatgtcgatgacctggtttaaacctaccgggttcttcactagcacaatggttagttccttaccatccacgttaatttgctcttggcggccaaagacccgttcgtcaggatcgttaagcgccttttgaatttgcgaagtgggtacgcccatgaacttacccacggagtaagccgcaagggcgttgtagacgttgtacaacccaccgatgtgcagggtaaagttggacgcgtcgatgaaaaacttagaatagttaggtgtcaacttagtaatctgcgttagttggaaattaagttctggccggtgccaaccgcagtgagggcagtagtacttaccctggttgctatagctaatgaatttatagtgaataatgtgttcacaacgcggacaaactacgccgtccgtgtttggatcggctttcatttcgccatccgcttggttattaaaaccgtaatataaaatcgggtttggtaaatccaccgaattaaagattggcatgtcgccattagcaatgatggtggcttccggagctaacttgaccccgtctaagattttttggtaagtggtgtaaatttcgccgtaccggtccatttgatcccggaaaatgttggtaaatacaaaggcaatcggtttaatatactgggtgaccttaattacgttagcctcgtcaacttctaaaacggcaatgtttttcccgtttttagaacggtggtcggtcaaaaaagtggtgacgaccccttgctccatattagaacccgtggggttggttaaaacgtgctcgtatttttgacgtaaaacctttaccgtaagtgcggttgttaaggtcttcccgttagttcccgtgatgacgattacgtcatagttttggcccagatcttttaaaattgtagggtcgattttggtagtaattttaccagggagtgaactacctccggaacgaaatgtatgcaaaaaccaatacgatgattttcccgccattttggcaattgaacttctaaatgacatgctactcctcccgattcttctcaaacatctaaaacaatattttaagctgattttggcaaaaagaaaagcaaagagtagcgggctgtgcaaaatcttaactattttaggccggcattcagccaagtgggtctgatattaaatttcgaaagccgggttgttaaagtaataataggaaaattttgaatatttcggaccggaaaaaggcgtttaaacgttgcgttacccctgtttgaggaaaaaactacattttatttttgagcggatgaatttttagtttatatcagctatacttatttcttggagaataaaattaggagtggggcaaaatggcacagttatttttccattatggagccatgaatagtggcaaatcgattgagattttaaaggttgctcataattacgaagagcaggacaaacaggttgttttaatgactagtggcattgacacccgttctggagttggcgaaatttccagccgaattgggttacgccgggatgcatttccgatttttgacgataccaatatttacgcggtaatcaaacaggcggaaacgaatccggcgtgcgtgctgattgatgaagcccagtttttaaagaagcatcacgtactagaattggctaaggtggttgatgaactagggattcccgtgatgacttttggcttaaaaaacgacttccgcaacgaactttttgaaggttcgaagtaccttttgttatacgcggataagattgtcgaaatgaagaccatttgctggttctgcaaacataaagcgctaatgaacttacgggtgcataatggtaaaccagtttacgaaggcgaacaggtccaaatcggtggaaatgaatcttactatccggtttgccggcgtcactactttaacccactaattgaagaaatgaggaattaattaatggatattatggataaagtgcaagcagttgcggatcgctacgatgaattaagcgaattgttggcggatccggaagtgttggctgattcacaacgttatcaagaattatcaaaagaagaaggcgaaatccgtgaaacggtagaaaaataccgggaataccgcaaagtggttgattcaatcgcggaaaacgaagaactacaacgtgaaaagcttgatccagaaatggatagtttggtaaaagcggagctagcggacttacgcgaccaaaaagaaaagcttgaagaagaaattaaagtattaatgttacctaaggaccctaacgacgataaaaacatcattatggaaattcacggagcggccggcggagatgaagccagtttgtttgcggctgatttatacaatatgtacactcgctatgccgaatcacaaggctggaaagtacaaattgtcgacgaaaacgccacggatgtaggtggtttcaaggaaatcgttttaatgatttcgggtgacaaagtttattctaaattgaaatacgaaaacggtgctcaccgtgttcaacgagtgccggtaacggaatccgctggacgggtgcacacttctaccgccacggtgggggtaatgcccgaagctgaagacgtggatatcgagattgatcctaaggacattcgtaccgacgtataccgttcttcaggtgctggtggacagcatattaataagacttcttctgcggtgcggatgacccacttgccaaccggaattgtggttgcgatgcaagatgaacgctctcagcaacaaaaccgggaaaaggctatgcggattttaaaggcccgggtttacgactactaccaatcccaagaagaggacgcctacaacgaagaacgaaagaatgccgttgggacaggggaccgttcggaacggatccggacttacaacttcccgcaaaaccgggttaccgaccaccgcattggtttgacgttgaacaagttggaccgggtgatgaatggggagcttaatgaaattattgaagcgttaatcctagacgatcaagctaagaaaatggaagctttacgaaatgaataatccaacatattttgaagccctgaaatgggcttctttgcttattcaggaacatcatggcgatgaaaatgctcccgaactgattatgatggaccggatggaatggaatcggacggaattacttgtacactatcgccagcaattacgtcttgaccagtggcaacagtttcaaaaagacgttcaacgagcggttaaaggggaacccgtccagtacattactaacaaggccaatttttacgggcgtgaattttacgtggattctcgggtgctaatcccgcgggtggagactgaagaattagttgaacacattttaaatgcgcaccctcaattaaaccaaccgctccgggttttagacattggaacggggagcggcaacattgccatcactttaaaacttgaacgtccagattggcaagttaccgccgtagacattgctagtgaggcactagcggtcgcccagcaaaatgctcaccagcaagaagcggtggttgattttcggcaaggttccttatttgacgcggttaaaggggaacgttttgacatcattgttagcaatccgccgtacattgccgaaaatgagcgggacgtaatggaccaatccgtgatagaatacgaaccagataaggcactttttgcaccagacgatggtttattttggtataaacaaattggtagacagctggctaatcatttaacgaatgctggccaattatggtgtgaatttggttatcaccaaggagcaaagttaaaacaatattttagtgaattgcctggagttaaggacgtggacgtgctccaagacttaagtggccacgaccggatactttgggtaaggggaggatcggtgatttagaatgagtgaaatatttcaaagtgaaaatttagctgacgcagccgcggcaattcagcgcggggaattggtggcatttccaaccgaaaccgtatacggcttaggagcggatgctactaacccagatgcggtaaagaaagtttatcaagcaaagggccggccatcagataacccgctgattgttcacgttacgggcccagcacaggtagccgagtttgccgaaatcgacgcccaaagtaagcagttgatggatactttttggccaggaccgctcaccattattttgccgatcaaaccgcacgcattggatccagtagtaactggaggcttgacgaccgctgcgtttcgtaacccagataccccgttaacccttaagttaatcgagcaggcgggagtgccgttagtggggccttctgcaaatacttcgggaaagccgagtccaactaagccagcccacgttatgcacgatttagatggcaaaattgcgggcgttttagatggtggcgaaactaaaatcggggttgagtcgacggtattggatatgtccggtgcggtaccaagcgttttacggccaggtgccgttactcctgaggatttaaccccaatcttaggagaagtgcaaactgatcaccataaagttggtaaggacgaagtgccgaaagctccaggaatgaagtataagcactacgctccgaatgcccaggtgtacatcgtcaaggacgctcagtggtcaaaagtggcggactgggtagcccaacatgcacaacagcccgttggggtattagcaacgtcggccatttttgatagtaccaagttgatgaattttgataacgttgattttatttcgttaggagaagatgcgcgaaccgcaagtcaccacctctttgacggattgcgtacctttgatgggaatccgcagattaaggtgatttttgcgcaagcgtttgatcctactgggattggtgcagcttatatgaaccggttgcagaaatctgcggggaatacttacttcgacgaaattaactaggagggattgccaatgaactaccaagaacaggatccgcaattgtgggcagcgattgatcgggaagccgatcgccaacaacataatattgagttgattgcttcagaaaacattgtttcggaagcggtccgggctgcgcaaggcagcgttttaactaataagtatgcggaaggttacccaggacgccgttattatggtggttgcgagtacattgaccaagtagaacaattagccattgatcgggctaaagaactgtttggcgcggaatatgccaacgtgcagccccactccggttcccaagctaacgcagccgcgtacgctgcatttatcaaacccggggataaaatccttggaatggatctgaacgcgggcggtcacttaacccacggtgccaaggttagtttcagcggcacattctatgaatcggtgacttatggaattgatccgcaaactgaacggttggattatgaacaaatccggcagattgccttaaaggaacggccacaaatgatcgtggcgggggcttcggcatacagtcggattatcgattggcaaaagttccgagaaattgctgacgaagtgggcgccttcttaatggtggacatggcgcatattgcggggctagtagctgttggattgcatccgtcaccagtaggaattgctgacgtagtgactaccactacccacaaaacgcttcggggacctcgaggcgggatgattttgtcgcaagcaaaatacgcaaaacaaattaatttcgcagtctttcctcaaaaccagggtggtccgttagaacacgtaattgctgctaaagcagttgcgttaggggaagctttacgccccgagtttaaggattatcaagctcaggtgatcaaaaatgctcaagcaatggcagaagtttttgaaagcgaaccagatctgcacgtagttaccggtggaactgataatcacttaatgacggttgatttgacccaaaccggacataacgggaaggaaattcaagacttattagataccgtttatatcacgctaaataaagaggcaattcctgacgaaaagttaagcccatttaaaacttcgggaattcggattgggactcccgccgttactacccggggctttaacgaagcggacagtcgcaaggtcgcggagctgatcattcgcgcaattcaccacgttgacgaaccagaagtactcgcccaaattaaacaagaagtgtttgatttaacggatcaatatccactatcttaaattaaacctagtttttttacggttttttagctacaattgataaggaatttgaaaggagcgagtttagacatggggaagtttgaagttctcgaccacccgttgattcaacataagttgacgttaattagagacaagaattgcagtacaaaggagtttcgtgaaatagttaacgaaatttcaacattgatggcttatgaagtttcacgggatatgccgttagaagatgttgaaatcgaaacaccaatcggaaaatctattcaaaaacaaatctcgggtaaaaaagtggccatcgtgccaattttacgtgcgggattgggaatggtagacgggatggctgaattgctacccgttgctcggattggtcatatcgggatgtatcgcgatgaagagaccttaaagccaaccgaatactttgttaagttgccaagcgacattagcgaacgccaagtattcgtagttgacccaatgcttgccaccggtggttcagcaatcatggcggtggatgcgttgaagaaacgtggcgcaagggacattcgtttttgcagtctagtagccgctcctgaaggggtaaaagctttagaagaagctcatccagatattgatatttatacagctgcattagatgaaaaactaaatgaagatggttacatcgttcctggactaggtgacgccggtgaccgcttgtttggtactaaataaataggtgcggtggattttataaccaacggttaagctgctgtgacaaaattctttaaacgaaaaacgattcatgaggtgaaactttctcatgaatcgtttttattttggcgttttgacttcaatagagccaaaacgtgggacaaaagtcagtttgttccgcttaaccaaaaattgaccatcatgccaaaatcaggcatcatggtcaattttcagttaatgctctacccgacttttgtcccactctcttttttgttttctgcgcggtttggtaagtgaaaagatttgtcaattgagaaaaaatagttttattatggtgttaatagaatacgcttacaaatcaggaggaacgtatggcttacatcgaagtacaacacgaatttaaaatttatcaaatgggggacaatcaaattgtcgcgaaccgggacgtgaattttacgattgagcaagggcagattgccgtgattttaggaccgagcggggcgggaaaatccacggttttaaatatgctcgggggcatggacagcccgacgaaggggagcatcaacattgccgggacggacattgcgcaatttaacgaccgccagttaacgaagtatcggcgtaacgacgttgggtttatttttcaattttacaatctaattccaaatctaacgactaccgaaaacgtagaactagctaccgcactggtcaatgacgggctagatccggtaaccgtcctaagagacgttgggctggcagaacgtttggataattttcctgcccagttatctggcggcgagcagcaacggctggcaatcgcccgtgctttagcaaagaatccgaaactattactatgtgacgaaccgactggtgcattggattatcaaacgggtaaacaaattttacaactgctccacgatgctagccgaaaatttaaaaagacggtcatcattatcacccataattcagcaattgcgaaaatggcggatcgggtaattcaaattaatgatgcccaggtccggagcatcgtagataatccccagcctgctccggtcgaagaaattgagtggtaggtggctgagatgataaaactattgttacgcacgattaagaattctttagggcgcttcattgcaattagtttgatcattatgctggggacgctgatttttgtaggggtaaaggcgaccggcccggcactcaatgattcactgcaagcgactgtagtaaagcatcatctaagtgatctagagattttatctagccaaggcttcaccgaaaccgaacttaaagcagttcggcaggttccgggagcgcaggttgaaggagttttattgcaaaacgtacttggcggcaagaatcgggacgtaatcgccttgtatggttatcaaaaaaataatcaccaaaatcagttgattttaaaacagggacggcttcctcgcaatcagcacgaaattgttttagaccagcaggcccggctacgcgaggggtataaaattggggactactttaatttagagaaaaattcccagctgaaatatcaaaaatatcgaatcgtgggctttgcggattctccccaatatgttgaccattcgactaggggagcgagtaatttaggtactgggaaagtaacttactttgcttacgtatcccatttagccttccgctcgttcgtgtactccgggatgcaagtatattttccggagctgcaaaaccaaaaaatgttttctaacaagtatcagcgggcggtaaaacaaaaaactgctcaagtacgccgccacttaacgccggcagttaaaaaacgtcggcaaagtttggcaaagactgcactagcgcaaattgaacaaggaaaacaaaagctggcacagagccgacaaaagctggtagctgcccaacaagcgcttaaacagcaaggtttaacgaatgcgtccacaatacgcaccttgcaacgtcaagaagcaaagttgcagcaacaacgtcggcaacttgatcagcaagcgcagcgggttaaacaagcgcttcaaccttcattactttaccaaacccgccaagacctgccaggttttacgggctacggagaaagttcgcaacggattgcagcaattgccaacgttttcccgttatttttcttcctattagcgggcttaatcaccttcacaaccgtaacgcgaatggtggaggaacagcgcggacaaatggggacgcttaaggctttgggctatgggaaaggtgcaattgttttccaatacgttgcctacgcaggtttagccggaattagcggtgcagctgtgggagcagtgctagggaaccagttgattccccggatcgtgttagcaatgtaccaagagtacgtggtagaaatcgttaaaattcctgtggattggcgcgcgattgctttagcggcgctcctgacgctgttaataactattggggcggcaaccctagtttcacttcgagaggttcgtaccaccccagcagcgttactccggccccgagctccccgtgcggcgcataaaatctttttagaacgggtgcccgggctatggtggcggctacggttcttccaaaaaattagctatcgtaacttatcacgcgctaagctacgaggattaatgaccattttaggaattgctggcggcacggccttaattttgaccgggtttggaattgcgagctcaatcaaagaggctggaaatcagcagtttcaacacgttctccggtatgacgcagtagtacgagctcggcaaccgaaagatttaacgagtgtcgaaaattctttagaacggagcgcggctactcgagcaacactgccagtttataccgcggtagtacaagttaaccaacgacaaaagaccgtgcgggacgttacgttgaccgtaccaaagaatccagggcaatttgaccagtttgtccggctacgtgattatcagagcaatcattccattggtttaccaactaggggagtggtggtttcacctaaggtagcccgaattttgcacgtacaggttggcgaccaaattaaaatacgggtgcctaatcaaaaaaaggtccaggttcgaatcgctaaggtagtgacaaattatgccggtaacgttatctatgcatcaccaagcgcctatcaacgtgcgtttggccacgcgccaaattttgcgagcgtcttagttaagactgatcaccagccttcagcacggcttacaaaacggtggatgtcggataacgacaaaattttaggcattagtttaatggctgatcaagcagaaatgatccaaaaaatgaccaagcagttaggaccgattgtaatgatttttattgggctttcagccatcctgtcgtttgtagtactttacaatttaaacaatatcaacattgcggagcgattatacgaactttctactattaaagttttagggttttataatcgagaggtgacgctttacgtagctcgggaaagtattattctagcgataattggtattttagctggttttggcttgggcaatcttttaactggttacgtgatcagacaagccgaaactaataacgtaatttttccgctaactatcaaaccattcgcttatttggtggcggttttattaatggtcatctttaacctaatcgtagtttatattacccaccgaaaacttcaaaaaatcgacatggtagcggcattgaagtccaacgattagggtgagaatttgacaagaattcaacgataaaaaagtgtgtttaaaaattgaagcggtaccatataaaaaaagtcgtagatatcggtaatcattgctttgtcttttgtcaaaattggtggtatcatttcaattgtattttcggacggaaaatactgtcttttgttcaagtttttgacttaatttttatcatttttggatggtaaatttaggtacacttaggtagaaaagaggtgatattctgtgggtggtgaatcaatttcaacttttcagtttcttggtctaacatttagtacggcaaacgtcatttcgggattggttgcggccataattgtatttgcagttgtgtttgcattttctcgaaatttaaaactaaagccgactggtaaacaaaatgccttagagtgggtaattgattttacaaatggaattttgcggagctcagttgacgaaacggaaacccgtaacttcggcttgtatgcatttacattgttcttattcatttttgttgccaatcagcttgggctgtttctacaaattgcgtggaacgatgttacgtatctaagaagcccgacagctgatccgattgtcactttaacattatcgttgatcacaatgatgatagcgcactattcaggtgtggcaaaatttggcttcaaatcgtacttcgaaagaacgtacttgtcgccatttaaaatttggttaccgattggtgtttttacagaattcattgatttcttgacccttgggttacgtatcttcggtgttattttcgctggtgaaatgttacttaagatgatcgggggaattgcgttctctggtggtatcttaaatatggtaatcgccattccacttgccttgatttggcaaggattttccgtattcttaggtagtattcaagcgttcgtattcgttacgttgacaaccgtttatatttctcataaggtcgaagacgaataatattatattttttaggtaggaggaacaactattatgggtgctattgcagctggaatcgctatgtttggagccgctattggtggtggtatcggtgacggaatcgttatcgcaaaaatgcttgaaggtatggctcgtcaacctgaattatcaggtcaattaagaacaaccatgttcattggtgttggtttggttgaagctatgccaatcttagccttcgttatttcacttcttgtaatgaacaagtaagcgtgataaattaagcaatttatcgaaagaaggaggtgtcaatagatgttttcgcacatgatattaggagcggcacaaggtagtactttgtacgttggcgatatgttgttttatgcgatcctttttgtggtcttaatggcattaattgctaagtttgcttggggtccggtcaatgcaatgttaaaagaacgtgcggatcggatttctaatgatatcgaatcagctgaacaagctaaaaaggaagcccaaaaacttgctgaacaacgcaaggaagccttagacaactctcacgccgaagcaactaccattattaacaatgctaagaatagtggtgctaaggaacgtgaactaattgtcggcaatgctcaagcagaagcgaagtcattgaaggacaaggctaaacaagatattgaacaagaacgtgctgacgcactcaagagtgcacaagacgatattgcgtcattatctattgagattgcttccaaagttatcaaaaaagaacttgatgaaaatagtcaaaaagaattgattgattcgtacattgaaggtttaggtgagagtaaatgagtttagataaaactacaattgctaagcgctactccaaagctttgtttgacgtggtcgctgaacaaaaccaaattgatcaagttcgagatgaattaaagcaaattcaacagatctttgatgataatgaaggattaggcaaaatgttgaccgataagggtttgaaggatgatcaaaaacgttcaattatggcgcttttgaccaaggatgcttcaaagtacgttggcaacttaattaaaatggcttttgattacggtcgaatggatgatttgaccgcaatcatcgctgagtttaaccgcttatgcgatgctgatgcttcagtcgttcgtgctaaagttatttccgccattccattaagtgatgaacaacttcaaaaaatggctgaaaactttgctaaacgtttgaaagttagcaaggttattttggatagtgaagtcgataattcgattatcggcggtgcaatcattaaaacagatggtttgatctacgacggtagtattcaaacccaaattaatcaaattagacagcgcctcgttggttagctcgaaatttgtaaagaggtgaaacttttatgagcattaaggctgaggaaatcagtgctctaatcaaacagcaattagaaaactaccaagccgagcttaacgttgaagaaacgggtacagttacctacgttggtgacgggatcgctcgcgctcatggcttagataatgctctttctggtgaacttctcgaattctctaacggtgtttacggaatggttcaaaaccttgaatcaaacgacgtcgggattgttatcatgggtaactatgatgaaattcacgaaggcgacaccgttaagagaactggtcggatcatggaagttccagtaggagatgccttaatcggtcgagttgttaacccattaggtgaaccgcttgatggtaaaggcgccattaaaactgacaaaactcgtccagttgaacataaggctccaggggttatgcaacggaaatccgttgatcaacctctccaaactggtattaaggcgattgactcgttagtaccaattggccgtggtcaacgtgagttgattatcggggaccggaaaactggtaaaactgctttagcaattgatacaattttgaaccaaaagaacgaagatatgatttgtatctacgttgcgatcggacaaaaggaatcaactgttcggacccaagtagaaacgcttcggcgttatggcgcgatggattacaccatcgtggttagtgcgggtccttcagaaccagctccattactataccttgcaccatatgcgggggcagcgatgggtgaagagtttatgtacaacggcaagcacgttttgatcgtttatgatgatctatcaaaacaagctgacgcttatcgtgagctctccttgattcttcgtcggccgcctgggcgtgaagcttaccctggggatattttctatacccactcacgtttgctagaacgggcagctaaattaagcgatgacttgggcggtggttcaatgaccgccttgccattcgttgaaaccaaggctggagacgtttcagcttacattccaactaacgtaatttccatcactgatggacaagtcttcttggatagcgattacttccattccggagttcgtccagcgatcgacgctggtacgtccgtttcccgggttggtggggatgcgcaaatcaaggcgatgaagaaagtttctggaacgttgcgtctagacttagcttcttatcgtgaattggaatcatttgctcaatttggttctgatttggataaggcaacccaagctaaattagctcggggacgtcggacggtagaagttttgaagcaaccgctacacaaaccacttcctgttgaagaccaagtgttgattctttacgctttgacacatggtttcttggataaggttccagtagatgatattcaacggttccaagatgaactctttgattatgttgcaagcaacaacaaagagctcaccgatgaaatccgtgaaacaaaacaacttccggacacggaaaaaatggatgcagccatcaaggcttttgcagaacattttcaaccaaccaaggaagctaaataaggatatcagctaacgagaggaaaagtggtgagaattaatggcaatatctgaacaagatgttaagcggcgaattgattcgactaagaaaactagtcagattacgactgctatgcaaatggtttcaacggctaagttaagccagattcagaaacatacagttggatatcaagtgtacgcgcagaaagttgagagtattgttgctcacctggctaaatcgcatttaatgaatgcgggagtggctggcaaagctagctctgatcaggctatatcagcagctgatttattagttcaacggccagtgaaaaagaccggatacttagttattacgtctgatcgcgggttagtgggctcatataacagtagtgtgattaagcaaactaacgatttcatgaaagaacacggtcatgatggcggtgatgatgccataattcttgcggtaggtagtaccggggctgatttttacaagaatcgcccacaaaaggtcggctacgaataccgcggggttagcgacgtgcctacttttaacgaagttcgggaaatcgtcactaccgtcaccaagatgtacaaagacggtgaattcgatgaattatacgtttgctacaatcactttgtaaatcgactttcgaacagcttccacgttactaaattgttgccaattggcggcgaagaattggtaaacgatggtaagcatgaaacgattactgctgaatatgaaaccgaaccatctcccgaagtattgttgcaagaaatcttgccacaatatgctgagagtttggtttacggtgccattttggatgctaagacggcggaacacgccgctagttcttcagctatgcgcaccgcttctgataatgcaagtgatttaattgcagatttagagctacagtataatcgcgctagacaaagtgctattacgactgaaatcaccgaaattaccggtggtcaagccgcacttgaataaattaacgagaggaattaaacaatatgagtactggtaaagttgttcaagttatcggaccagttatcgacgttgaattcccccttgacgaagaaatcccaacaatcaataatgctttgaaaattaaaaaagcagacggtacaattttagtttctgaagtaacgcttgagttaggtgatggtgtcgtaagaaccatcgctatggacggaacggaagggctacaacgtggcctggaagttgaagatactggagactcaattaaagtaccagttggtgatgaaacacttggtcgtgtttttaacgtcttgggtgaaacaattgatggtggtaaagagctaggtccagatataaaacgcgatccaattcatcgtgatccaccagaatacgacgaattgaatccaagtacagaaattcttgaaacagggatcaaagttattgacttacttgctccatatagtcggggtggtaagattggtctcttcggtggtgccggagttggtaaaaccgttttgattcaggaattaattcataacattgcacaagaacataatggtatctcagtatttactggggttggagaacggacacgtgaaggtaacgacttgtacttcgaaatgaaggaatcgggcgttcttgaacgtacggccatggtgtatggacaaatgaacgagccgcctggggctcggatgcgggttgctttgactggtttgacgattgcggaacacttccgtgatgttgaaggtcaagacgtgttgttattcattgacaacattttccgctttacccaagctggttcagaagtttctgccttacttggtcggattccttcagccgttggttaccaaccaaccttggctactgaaatgggtcaattgcaagaacggatcacttctacgaagaaaggttcagttacctcgattcaagcggtttacgttcctgccgatgactatactgaccctgcgccagcaactaccttcgctcacttggatgctacaaccaacttggaacgtagcttaacccaacaagggatttatcctgcggtggatccattagcttccacatcgacagctttggacccagaaattgttggcgaagaacattacgaagttgctagtgaagtacaacatgttctccaacgttacaaggaattgcaagatattatctcaatccttgggatggatgaactgtctgacgaagaaaaaaccgtagttgcacgggcacggcggattcaactcttcttgtcacaagactttagtgttgcggcacaatttactggtttaccaggacattacgtcaaattggaagacaccatcgctggcttcaagggcatccttgaaggtaagtacgatgacctcccagaagaagcattccgtttggttggttcaattgacgatgtggttgaaaaggctaagaaattaactgctacagaagattaggagggatctaattggctgaaaattcagtattaacagttagtattgttactcctgatggtcagatttataatgatgaccaagttaccatgctggtagtcaataccagagaaggtgaattgggaatcttacctaatcacgttccagtaattgcaactttagcgattgacgaagtgcgcattaagcatgacaaagctgaagatgtagtggcggtgaacggtggttttgttgagttttcagataacacggcaacgattgttgcggatactgctgaaaatcaagctgacattgacgtagcgcgagctgaaagtgctaagaaacgtgctgaggcaacgatccgtaaagcacaacaagctcacgataatagcgagcttcggcgtgcgcaaattcatttgcggcgggcgattaaccgaatcaacgtttcaaaacattaaagctagttaatattattattgataacgttcagtttatgaggaatttttcctcacaactgaacgtttttttttgggaatgggccggtaaattttcacaaattgagcagaattgcggagcaaattaaccgctgtttttgtgagtaaaaagttattcttagcttgattttctggtacaatactatatgtatgaattttggagggaaagcgattgggaattcaagccataattacgttaattagttatttattctttattttactggctttttggtgtattcaagcaattccgtttcataagtttatgggccggtttgaaagtcaggcaaaaatgttaattgttttgctttcaattgcgttaggctacaccgttgctagttttttcttaggtttgattacggcaattcagaacttaacttttttagtgcgttagaaggttagcgataatgaagagtttcttattaatgctggttcgcggatatcaaagggtgatctcacctttatttcccccttcgtgccgttactatccaacgtgttctaattacatggtgggggcgctcaagcgctttggtgcgttgcagggcactttaatgggaattgcccggattctgcggtgtaatccgttcgtacggggtggttacgaccccgtgcctgatcaattttctttaaaaagaaattcaaaaaatagtgcagaaagaaaataggagttaaaatgtcacgaaaagaaaaaaagtttgctattgaagtcaaagaaactaacaataacggtactacggttaacgaagtttacgttaaccaacggatgattggacaaatatctcaagtaaatgataagaattgggtagcttccaaccaaagcggagaaatgcgagtaaaatcaattgatgaggggattcagtggattatcgctgaatttaatttacattcgctatagaaaggagctacttcgatggaaagaaatgattctcgagtagcgcgtaaagacgacagctctcgcattgactatggaattatctttccggtacttatgttggccattattgggctagcatcgatctatgtagctgctacgcacgatactagtgctaccagcgtatttcgccaagtgttctcccaactaatttggtaccttttgggagtcggcatcgtggtggtacttatgcaatttgatgcagaccagctttggtggttagcaccaattgcgtacggagcagggattgttttgctcatcctggtgctcttcttgtacagtcgctcgtacgccgcaaataccggagctaagagttggtttgcctttgggggctttacctttcagccgtccgaggtaatgaagcctgcgtacattttgatgatggcgcgggtgattacggtttataaccaccgggtaaaaaatcgtacaattcaatcagattggcggttaattggaaccatggccctttggactttgccgattccaatcctgttgttgctccagcatgactttggaaccatgttggtgtttattgcaatctttattgggctggtagttgtttctggggtaacctggcggatcttaatcccatccttcgtaggaatggtagttttaggtagtacgacgcttatgttagtggcgcttccttgggggcaagccctattacaaaagatcggctttgaaagttaccaatttgctcgggtagataactggttgcatccgtcttcggatactaccaattccggatatcaactttggcaaagcatgaaggcgattggttcgggtcaattatttggcaagggcttcaacgtctctaacgttaacgtgccggtccgggaatccgatatgattttttccgtaattggcgaaaacttcggattcattggaagtattgttctgattggtttgtacttcttattgatttacaaaattttacaagtaatttttgacaccaaaaacgagttttacgcttatgtagctaccggagtcatcatgatgattttattccacgtttttgaaaacatcggaatgaatatcggacttttaccgttgaccgggatcccactaccatttgtgagtgccggtggttccgcgttaattggaaacatgattggaattggattgataatgtcgatgcgctatcattactattcgtatagtaaggcaagcatcgaagaaaatgccgatttttaattaagccattgaaagaatccgcaccgtcggaagtgctcgcactgaggtgcttcgccgggagggttcttttttagtgatttagttgttgacaaggcttgatattggaaggtatactttagcgtattaacaaattattaaaaaaagatgagtagattacggttctacgcttagagagtccttgggtggtgaaaaaggaacgagaacgttatcgaagatggtctttggttattttcagcgatttgtgagcccggtgctagcaaatcatgggagcgcccaatatagcgcacgggttgatggacccgcagagtctgcccttcgtgagaagggtggaaaaacaaggtggtaacgcgataaactttcgtccttgagaatggtgcttagtcattattctcggacggaagtttttttgtttgaaggaggaactgaaatgattgaatttaagaacgtgtccaaaactttctcgaccaagacggggccagtaaccgcaattgaggatgttaatttagcgattccaaatggtcaaatttttggcatcattggttattccggtgcgggaaaaacaactttgattcggatgttaaacggactagaaaagccgaccacgggtgaagttaaaatcaatgatgtggtcattaatcaactaacgggcgcggcactagcgcaacagcggcataaaattgggatgattttccagcattttaacctattatggtcccgaacggtaaaggctaacatcatgtttccgctagaaattgcgggagttagtcgcccgcaacgggagcaaaaagtacgtgaactaatcgaactagtggggcttactggaaaggaagatcgttaccctagcgagctgtctggcggacaaaaacaacgggtgggcatcgcccgtgcattggcgaacgacccggaaattcttttatcagacgaggcaactagtgcactagaccccgaaactacggatgaagttttagatttgttattagaaattaaacgcaagcgaaaaattacgatcgttttgattactcatgaaatgcacgtaatccgtaaaatttgtgaccaagtggcggttctcgacggcggaaaaatcattgaagatggggcggtattagatgtctttaaacacccacagcaagcattaaccaaacgatttattaccgcagaaaccgatccaactccgcaagataccgaaataattttggatgaattagttgatcagaatccaaacggacgggtggtgcggttaactttccacggtgatcaagctaaattgccaatcgtttctgaaatggttcatgaatttccagaggtggcgctgaacatcattgctggaaatatcaaacagacccaggaaggttcaattggaagcttgtacgtgcaattaaccgggccccaaagccaattggatggcgcggtaagttttctacgtaagttaagggtggaaacggaggtagttagtgatgaacagtagtattttagattttagtaccgtagattggaatgaaatgggtcaagcaacttgggaaacgatttgggtaacgttggtggcggtcatttttaccgccgtcttgggactcctaatcggcctactgctttttgaaacccgaaacagtaagaattgggggattcgtctaatcaattggctggtatccttcttggtaaacgtatttcgctcgattccatacattattttgattgtaattttaatccctgtaaccaacgtgttggtgcataccattgtgggaccaaccgcggcgttgccatcgctgattttagccgcggcaccattttttggacgattggtggaaattgcatttcgagaaattgattccggagttttggaagccgctgccgccatgggtgccaaaaaatcgaccatcattttcaaagtattgcttccagaaagcatgcctgcgctagtttccggcttaacggttaccgccatttcgttagtgggatacaccgctatggcgggggcaatcggggccggcggtctgggtgcgttggcttacaataatggttttttgcaatataacggagccattatcttagttgccaccgttttgatcgtactttttgtttttgcattacagtggactggcgattggttagttaagaaaatcgataagcggttagtttaggagtggttaaatgaaaagaaataaattaatttttttggttagtggcttagcaatcatcttgcttttagcagggtgcggaaaaaaatccgcgaatactcaaaaaatcacgattggtgcttcggcggttccccacacggaaattctaaaacatatccaacccgcattaaaaaaagagggtgtcgaattagatatcaaaacttttcaggattacgttttacctaataaagccctcgcgagcggcaacattgatgccaactattttcaacatggtccctttttaaaagaatggaatgaaaagaatcacgggcacttggtgagcgctggggcggtccacttggagccgattgcggtttattctaaaaaatataattctttaaaggaattgcctaagcatgctaaaattttggttagcaataacgtttcggattatggccgggtgctacaaatttttcgggatgccggattaattaccttaaagaagggtaccgacctaaccaaggcaaaatttagtgacatcgcaaagaatcctaagcaattgcaatttaagacgggttacgaaccaaaaattatgccccagctgcttaaaaataaacagggcagtgcggaagtaattaattctaattatgcggtgcaagcgcatttaaatccacaaaaggacgcgattgcaacggaaaactccgcctctccttatagtaatattgttgctattcgaccggatgaaaaaaatcgaccagccattaaaaaactcatgaaggaattaaagtccaagtcaactcagaaatggattaaacaacatttcaagggtgcggttgctcctgttgaataggagaacttttccattgctgtgactaaatgctagtaaggatagtgggacaaaactaaaaaatgcttttcaaagatgaaagagtctttaaaaagtggttttagttttttaactttaatagagccaaaacgtgtgccaaaagtcagttggttccgcttaaccaaaaattggccattatgcttgaattttgcataatggtcaattttcagttaatgctcgcaaactacccgactttgatcccactcttttttatggaaaaaggtccaacttgtaagggaattaattgtttagatgatgggcggcaattgacttttaggctgagaacccatatagttagttacgtgagtaattaggttagtaaataatataatttgaaggtggattttatgcattttaactttaatagcagcgaaccaatctatctccaagtcgcccaacaaatcgaagatgcaatcttcacgggtggttttaaagaaggagaacaaatcccctcaacaacggaaatttctaaggagtttcacatcaatccggcaacggttttaaaaggaatgaaccagttggtagcgcggaacctcttagaaaaacatcggggagtcggcatgtttgtagtgcccggggcgagtaaacaaattactttagaccggcaacagaatttttaccaaaagtacgtggtgggcgtcgttaaggaagcgattcgcttaaacatcaccgaaacagagttaaaaaaattaattgaacaggggtatcaatcgttatgaaaggtatcgaagtaaggcaagtaatgaaaacttttgaccaccacttggttttaaatggaattggattaactctagaaccgaacaagatatacggtttactagggcgaaacggggctggaaaaagtacgcttttgaatttgctggttaaccgaattaggcccgatgaaggcgaaattaagctggataacgaattgattggtgataatgatcggcaactgggaaagctattcttaatgagcgaagtggatctttatcccaaaaatattcgggttaaggacatttttaaatggtctgccaatttttatggtagctttgatagtgagttagcacattcgttgagtaaacaattcggtctaaaagagtccatgctttttcaccatctctctacgggataccgaacgattaccaagttaatcgtggcgctatctgtcccggctgaatatgtttttttagatgaaccagttttaggtttggatgctaaccaccgggaacttttttacaatgcattagtagaaagttacgcggaaaagccccgaacttttgtgattgctactcatttaattgaagaatttgccaaattgattgagcacgtaatggttatggaccaggggcggatcgtggttgacgacgaaacggaaacggtcttggcgaacgcatacaccatcagcgggcctgttcaagcagttgatcaatacaccgcggggttaaacgtcattggcagtgatcgactagcacggattaaggctaattacgtgtatgggccgctaaatgatcgaccaattccagatgagatcaatatcgatccaatggatttgcagacgctttttattaatttaacaaatgggggagaaactcatgaataaaattgcggcggtggttaaatatgatttaagcaattatttacgcctcgtgctaatcgcgtacgcgtggattatcgggttaatgctgggggtgccaaccattattcacgtaattggcaaaggctttacgggaactgctgagacaattggggcccaattaacgacgctatcgtttggcgcaattttcgttaacctcgtgctgatattctattgtggtttcctaacttacgaacgatttgcatttttaatccaaaatggggtctctcggcgaacggggtggattgctaaattaatttcgctcttagttttagctggggtagccattatttatggcttattagctaacatgctttccttaatgggtgaccagagtaagaatgtttccctttattggtcactttacggacatttttataagaatggcgtcctcaacatcctttcaatgattctaactaacttaatttttctgctcctagtggcagcgggtggaatgatgttaggagcactctttgcactgcttaaccggcggcagcagcgggcaatcctagtggggattccgctagtgctgattgttattttcacgattattggacgaatggttagtgaaaaagtaattacgtgggaaagaattgataatttcattagatttgtcatgggtgatacaggaccaatggggcatcttaacccggtagttccttccataattatgttagtattaatgttagcatgtttagcaatttcgcgatggttaaacgtgcgattaagactgaaacgaggagaatagccgtttaatgaatgattttacaagtattaaagcactaaagaaacgtactttggatacgtatcaaggaaattggatggcggccattaaagccaatatcttaccaattataagtgccgcgtttactagttttatgattatgacttttattgggattgccgtagtagtatttacccaaactgacccagcgacgttgcgtcaggctacgaattatgatcaagcagcgagtgttaattctgcatattccggaacggggatggcgcgtgattttctatcaatggcaatcgcgaccttctttatggtaggaattcaatacggtacgttagattggttgcgcaatcggacccggattccttcgtggggagcgccatttcaaacgtttactcggaaatactttacgtccacgttggccatctttttatttgagtttattttcttaacgctgtggtcctttttgttcgtaattcccgcgattattaagttttactcgtattcgcagtcgtatttgctgtacaaggacgcacaagaacggcaattgacggatcaatttgaatttgtcacctttattacgtttagtcgtcgcttgatgaacggctacaaagctcgcttcttactgcttcaattatcgttgttgggctggtttatcctaagcgtattaacctttggaattggcttcctatggtacattccgtaccgtaacggagtgtacaccgccttttacgaagatttagttgaaaaacggggtaaacaagtggtgccagaaatttttgcataaagctaagataaaacttgctatctaaaaatattaaaaattccttctaagaatgggagcgcctcaagggttccaatcgtagaaggaatttttttgtttgttaagtgtggttgcttgttgcggagccgaaatgaactgcgcacccaagcttctttcggttgactaaattaaaggactaaccacaaatttcgtggttagtccttttggtattctctgcaatatggttgaaatgaattccagccaccaatcttttccggttagcctcaatcattcgattaagctaatcctcgaagattacccggtggcttcagttctctttatttaatcctcgaatttcttgctccgtatgccaagtatactaccaagccaattgcaaaccagatcaacgagtacaacttagcttggtaatctagtccccagaacactgccaacgttcctaaaaaggctaacgccggtaaaactgggtaaaatggcatcttgaagcttggcaccgcgatatcctttccttcacgcggacgaagggcgtaaattcctaacgtaacaaacatgaaggcaattaacgttcctgctgaaattaattgtgccaaaaaggcaaacgggaacagcgacccaataataattccggtaacggttaaaaatagcaacgcttggttaggcaattgatgacgatttaatttaccaagccacttaggcagcatgccgtcccggccaaatgaatacagcaaccgggaaccagccatcatcattccaatcagggcggtaaacattccgattaccgcgattgcttgtactaagctagctactgcaggatgtccagcagtgcgtaatgcccagccgaccggttccgcattatttgcataattagagtaatgaaacatcccgactagcacaagggcaaccgctacaaaaagggttaccgcaattgctagggatcccaaaatcccacgcggcatcgttttttggggatccttagcttcaccagcgttggcagcgattgaatcaaaaccaatgtaggataagaaaatcatcgaaactccagcgtaaattccgctccagccgccaaaatgactaccgtcgggtaacacgcgcggatgtggaataaagggaacgtaattagataaatgaaccgaagtaacgcctacgatgataaataaaataatggccaaaacctttaataccacgagggcgttttcgatccgtgcggcctcagaagttccacaggctagtagaatggcaaccagtaggatgacaatcaaggcgacaatgtcaataatgccgccgttggttcctaggggattggccagggcagccggcaattttaagcctaccgtagaaattaacccccggaaattagctgaaagcccggaagctacaaaagctactgcgatgaaatactcggccagaagtgcccagccagcaatccaaccaaagccttccccaaagattacgttgatccaggagtatgccgaaccggcgaacggcattgccgaagccatttcagcgtaagcaaaggccactaaaccagcaactaccgctgcagctagaaatgatagaactaccgccggaccagcgtgttccgcagccaccactccaggtagtgtaaaaatagtggtcgaaacaatggttcccacccctaaagatagaaaatctttgacagtcaacgtgcgcaccaggttggcgtccttatcttcgtattgggaaggatcctctttatgaataaactttttaatgaatgaactcatcagctttccccctcgtaaaagtatctgatttaaatatcataccataaattatcatcattttttaatcttatattaatttaaggaaagtttttctagggaatcgtaacggcaagtttcttcgtgtaggttatggaaagtgttagaatcaaagtagtaaaaagaagaggagtacgaaaaaatggatgcaatcgaaacgacccgccagaagctaagacaattacgcgttaggctgcaacagggcaaaatttttgcctctttaggtcgttcggtaggggcaattattgatgctgctaaagagaatcaaaccgttaaaccagtgacattgcctgatgatcaggacggcattgaagagttgctccagcgaattcgggcagccttggggaagggaaaactagaagagcttagtgacgctgatttagacttaatgttgcaacatttgggatcgcccaacccaattattcgggataagggggttttttacctttttaatgatctcattcaaaatcaagttttaactaaggcacagatggtgcggacgtttgatcgactaactagcgaccaagtgttatttgcgcacatcaatgaaagagaaaatgacgcagcctttttgcgttcctttgcagtgatgatgctggcatcgttaatttatattgaccgagccggggcagcgtttatcgaccatgcgcgaaaaaataagctagtcgagcaactagccatatatataatgttggaaaatgatactaggggatttgtggctaatcaaggatgggttcacgcatatactcacattggcaacgttttggacgagctagctagtgatgaagaactgttacgcgctgataaaattttattaatggcaacggtcattgaaaaattccgccgactcaccacccctttaatatacggtgaaccaacgcgtttagcggtttattttgctgatcaattgttagaagatgacgtctaccaacagtttttattaatcgaacttcgcgaatggcggcgcgccctggcatcaacccaagtccgggaaacccaggcaatgtggaatgcaatttttaatcggcagcgattactgcaagccatgatgctaaactccaacatggctaaggcagtggtggaatatttagaagattcgaatgattttacaatttaagcgcaatatttttaattttcatctcattcttgaagttgttttgtggtatacttgagtttcaaaaaacgtttgataattggcggagcaaactgaagtttgtaattatcttacacatgaggtgaaaaaaatgaaaattgcagtgcttgctggtggaaagagtacggaacgaaacgtttcactttcctctggttcaaaaatcaccgatgctttgcgtgctaaaggccacgaagcaacgatgatcgacctattcttgggatatgatctacaagaagggcagactgttgaagatgtttttaagactagtaatacggattcggactacgaaattcagacggacgttttaacggatgctgatatcgaaaaacttcggacggatggcacggttggattatttgggaaaaacgttttggaaatcctccgggctgccgactttgtttttctcgcattacacggtggtgatggcgaaaatggtaaggtacaagctgttttagacctgaacgatattaagtatacgggaagcggaactttagcatcgggaattgcaatggataaggcgatttcaaaggaaatcatgctttataacgatattaagacggcacgctttgtggttctccatgaagaagacggaattcatcctcagttagattttggttttccagtagtggttaaacctaatagcgggggatctagtgtaggaacgatgattgtacacgacgaagaagaattggctgattcgttacgtgatgcttaccgatttgacgatgaaatcattgtggaagagttcattactggccgggaattttctcttggggtagttaatgaacaagccatgcctgcaattgaaattgtggttaatgatggttggtatgactacgagcataagtttaagactggtacgacgacccaatttatcacgccaccggacatcgatgaagaagtccatgacgaaatgaagcgggttgcggtaaaaaccatgaaggtattgggaatgactaactatggccgggtggatttcttggttaatgaccagggagtttacgtaattgaagcaaacaacttaccgggtatgacgccgctatcactattgccacaagaggcagaagcagcgggaatcagttatgaggacctctgcgaaagcatcattctaggcaagcaaaaactttatcaagaagcagaaaaataaataaagaaacctcccttagagtaactacatctaaaggaggtttttttatgcgagaaagttgtcaatgggccacggtcagccggtattcagaagctaaggttcaacagcttttacaagacccactgatgattaaaaatgaacgtaaggttcgctcagtaatccataatgcgcggataatccagcaaatggcccagcataagcaatccttcagcgactggttatgggcacaagtaggtttcgttcccctagacttacagcaacggactaacacaaaggtgctggttcagcatccggttgctaaacgagtttgccaggaaatgaaggcgcaggggtttgaatttgttggtccccggaacgtcagcttttttctacaagatgcaggattacttaacgggcactgggtcaactgcgagtattatcaaaagtggaattaggtaattaatccttaagctggaaaattaaaaagagagtgggacaaaagtcagtttgttccagccgctttaatttatcaatttgatgagtttccagcattagtcgcgtaaaaagttcgacttttagtcactctatactaacaatttagttgttttctagactagtacgaaccactaacacgtcgcaagttgctgtccgggtgacgtattcggttactgaaccgattaataagcgttcaacagcattcaaaccggtcgcaccgatcatgattaagtccgtgtgcaattctttggggacgtcctgagaaatcactgcttttggcgtaccgtattcgattgaataggcgatgttttctaaaccatcgtttttagcttcctcaacgtaacggtctaacgtctttttggcagtttccgtaacttgttccaccattgcgttgtcaaagttagaaatattttgaaaggcacgggtatcaattacgtgaaggagatgcaattcagctccatcattacgtttagctaccgcgaccgccttgcgaaaggctaattctgcttccttagaaccatctactggcacgagaatatgcttatattgttgagccataacataaccacccctatctatttacactaattgtacgttaaaaattagaaaataaaaaggaatttgctataaaaattttaataaaaatagcagcgtgcccgtggttgacacaattccaagtaccaacccggccataattaggggagtactgctactaattcccgcaattaaagtcagcaggctaacgatcataagtaaaataccgataactcgtagactactgcttaaaagcgaattagaagttggtttaaataacataaaatctcggtgctgatggcgatataaataattgccgatgtaaaaaataataagtgaaaaaataaccattaagcctgggattagcataaaataacctactttcatgatataaaaaaagccccacctaatgtgggggaagaactaacgacaccgttcagattggccaggatctaacccaaaaggcaaggtgggtacccatacctacgctgcacgtttctcgcttacgagcctacaattcacgtacgatcccgggttcccggttagatgtttgttggaagaatatgaaaccaatcctctcgcatgcctcggtttcttcacattcatagtactataacttttacctaaaagacaatattaaagtcctgatttttgtgattttttcaggttttggtactgttcgtaaattttagattcaaaaggactatttcccttagcctcaaggtaggtagcattctttaattgattaggcaagtattgctggggaacccagtcgttttgataattatgcgggtaaagatagtcagttccccgacccaacgcttttgcaccttgatagtgggcatcacgcaggtgatcagggacttcaccgattttgccatcgcgaatgtcaccgagtgcgttatcaattgccgtaattgcagcatttgatttgggagaaacacataattcaattacggcgttagcaaggggaatccgggcttcgggtaagccaatgtgttcggccgcggtaaccgcagcgaccgttcgttgacatacgggagggtttgcaagacctatgtcttcataagcgattacaagcagacggcgaattacgctctttaagtcaccgctttctaataaacgggccatgtaatgcagcgcggcatccgtatcgctgccccgaattgatttttgaaacgctgaaatcacgtcgtaatgggcgtccccgtccttatcctgggtgagtgcccgtttttggagacattcctgaagaatttccaaagtgaggtggattttatcgtcgtcacttggtgaggtggaacgagcggccaattctaccgcgtttaaggcgctgcggagatcgcccccggttgcttcgctaacaaattgcaacgcgttttcatccatttggagggggaggtcacctaacccacgttgagaatcctgaagtgccatttcaacggcttccttaatgtcagcgggagtaaggggcttaacctcaaaaatttgagtacgactacgaattgccgggttgatattaatgtatggattttccgtagtggccccaattaaaataatctgtccgctttccaagtggggaagcaaaaagtcctgcttagtcttgtctagtcgatgaatttcatcgagcaagaggacgaccgtcccactcattttagcttcttcggcaacaatctggagttgttttttagaatccgtagccgcatttaacatgcgaaacgcgtatttggtcgaaccagcaatcgcactagcgatactagtctttccggttccaggggggccgtataaaatcatagaagataaccgtttggccttgaccattcggctaatgatttttcccgggccaactaagtgcttttgcccaaccacttcttcaagggttcgggggcgcatccgatatgctaatggttgcatttttcctcctcaaaataaatgaaagtaaataaaaaaacggccgtagccgttttcctattatagcttgttgtagtattcaacgataagtgagtcgtcgatttctgcttcaagctcgtcacgttctggaaggcgaacaagtgaaccttcaagcttgtcagcatcgaattgaacgaattgaggacgtccaacgactgcttcaacagcttcgttaatgatcttaagatcttttgatttttcacgaacgccgattacttgaccaatttcaacttcgtatgatggaatatcaacgcgcttgccatccacagtgatgtggccgtggtttactaattgacgagcttgacgacgagtagttgccaaacctaaacggtaaaccatgttgtccaaacgacgttcaagtaagatcatgaagttagtacctggaacaccttcgcgcatcttgctagcacgatcaaaaaggtttgcgaattgacgttcagttaaaccgtacatcatccgtaacttttgcttttcgcgaagttgcataccgtattcagaaatcttacgacggttgttttgaccgtggtcaccaggtgcgtaaggacggcgagccaattccttaccagtacctgacaatgaaataccaagacgacgagaaactttccaacttggacctgtatatctagacattaaaaaatcctccaataaattatttttgttggagtaaaataaacaaatgtgggtttagtattcgtgcagattgctctgtaattttcacctttgcagccgctaagggtactaattaaccatttaaaaaggcaacaatctgttgacgagcttaccgcccaccgctgcattattttacactctagctagtttaacgcacgcaaaacggacttgtcaatgtgtttcattaaagtagcaacaaaatcattaagaacctgttcatccgttgcgctgaaccggtttaaactaggcgaatcaatatctaaaacgcctattggttgcttttctaccattaaaggaattacaatttcagagttagatgcactatcgcaagcaatgtgacccggaaattcgtgaacgttagcaacgcgcaaagtactttgctgttttagagcggtgccgcaaacgccgctgccgttttgaatatgcatgcaggcaactttgccttggaagggacctaagatgagttcgtcagcattagcatcgtataggtagaaacctgcccagttgaggtcgctaatttcgctatacaacaacgccgctgcgttagctaggttagcaatcgggtgtggttcgtcagttaaaagggcgtcaatttggtcaatgataattggagcaattgtcttggacatggtggtcacttcctaattttaagtagtttaattaaaatcactgctttaacagtagatagggtatgctataatttataatggattaaattctaaattgaagaatcttaaaaagcaagtttttcataaaggaattgagtgaagcaagaaggatgggattttagatatgatcatagtattgatttcagtcatcgtggtagcgattttagtttacctcgggattgttgcatatcaacgttatttactaaaacaggtcgatgaactgttaaaccgcaaggcggatattagcgaatcaccgatccgccagaagttaatggaagtatcttcaatgaacttaaccggatcgtctgcggtcggcttagataacatccgcaatgactaccaagaaatcattgatcaccgcttgcccgaagttgaagatatcgctaaccattcacgtcaaaatattaatgatatgaagatatttgaggcgcggaaagatattacgacggttagtgagactctcgatgcgattgaagaggaaaccaagcgtttgaatgaccaattggataatatccaacgaattgatcaagaacaacgtgatgcggttaaggtcctccggatgaaataccaagagattggcaagcaattgcttgaccaaaacctatctctgggaccaagcattgatttgcttgaagaaaagctatcccggttaaacgaagatttcgatacgttcaaccagaccgtggatgctggggatcacgaaaaagccgaaggtcaacttaagaaattaaaggccagcacttctgaaattgaagcagaaattaaggcaattccttcgttatacgatgaattaaccaacttatttccttcacaaatcgaagaagttcgcgatggctatgaccagttaattaatcataactacgcttttgaaaatgacacggttaaggacgaaatcaaggcaattaaagccaagattaatgataatttagaaacccttagcaatttacggctggatgctgtgcgagctaataacaaggcgattgaaattcgaattgatgaattatatgacattttacaaaccgaaattgacgctcgtaaatctgtagagcacaacttcaacgtaattactcgattccttgatcatgctgaaaaacaaaataaagtgctcctttctgaaattgctcggctagaccaaagctacgttttaaacgatgatcagctaaaccttggtcaagttctagagggccaattaaacgacattcgcaatgaacacgaccgggacacggaacgcattactaaccaaccggtggtttattccgaaatcgtagaacggctaaaggaagaaaatgaacagctaactgaaattgaagaccggcaggcagccttgaatagtgaattacaggaaatggtcgatagtgaaaaggacgcacggacgcgtttgcaacaatacgacaatgaaattcataacattaaacggcacgtcgaaacgctcaacttacctggtattccagaaggctacatggattacttctttgtggttagcgacgaaatcgaaaaagttggcagtgatatgaatcaagtccggatcaatatggggatgattaaccgcgaattagacatggttagcaccgacatccaaaccttgattaagaagacttctgatttaaccgatgatgctgcaattagtgaggcggccatccaatatgctaaccgttaccggcatactgatgaagaggttgcggcagccagtcaacaagcgcaaaaactttttgataaagaccaccgttacaacgaaagcctttcagtaatttcgaaggcgttggacaaggttgaaccgggagcaatcgagaatattacggaaaactactaccaacaaaagaaaacggaatattaatctagaaatattaggttaactgatatagggatcaaggttccacaattaaaaagcggcaacggaggctgggaaattttttctcggcctctgttttatgtaatggggatggaatttttttcaaaattaggtagaattttaactggttttgaaaatggtaaaattttgacacgcttcccatttgtaagtagaataatggaatgtgattaagcgggattttaagttagggatgaggaaaatgatttactttgacaatagtgcaactacgcaagttgataaaacagtcttagaaacttaccaaaaggttagcaatcagatttggggaaacccctctagtttacacaacatgggtgaaactgcgtttaatttgcttgaacaatcacgtaaacaaattgctgacttgttaaacgtgcagccacacgagatcttctttaccagcggaggtacggaaggcgacaactgggtgattaagggaacggcaatcgaaaaacgtgcttacggaaaacacctgattaccactacggtggaacatccggcggtccaaaatacgatggctcaattagagcaactcggctttgacattacttatttaccagtagatgacgaagggcggattagtatccaagatttgaaggatgcgattcggccggatacaattttggtttcaatcatggcggttaacaatgaaattggtacggtgcaaccgctcaccgaagttgccgaagtgttgaaggattaccctaaaattcattttcatgtggatgcagtccaaggaatcggtaagggaattcaatcggccatcatgaacgaccgggtagactttgtcactttctcgggacataaattccacgctccgcgaggcgtcggctttatctacgcgcggcaaggtcggcgaattgcgccgttaatgactggtggcggacaagaaaagaatttacgcagcggtaccgaaaatttaccagcaattgcagcgatggccaaggctttgcggttgttactaactgacgaaaagcaaaaagttgcgcaccaagctcaagtaaaacaggctatttatgatcacgttactagttttgacaaagtagtcgccttttcgaaatgtgatgctggctttgcgccccacatcctgtgctttgcgattaagggagtccggggggaaacaattgttcacgcgtttgagagccacgacatttacatctcgacgacgagtgcttgctcttctaaaaaacaacaagcttctagtaccttgacggccatgaacgttgatcaacagatttccactagtgcggtgcgggtcagtttagacagtgctaacactatgaaagaagctgaacgctttaataaagttttcgaccagttgtaccaagacttttctaaaattaatcaaaatgcttagataggagtttttatggaatatacggaaattatggttcgctacggcgagctatctacaaagggaaaaaaccgaaaagattttatcgcccgcttaggcggtaacattcgtaaaagtttaaaagactttgaacaagtggtggtccaccctaatcgggaccgcacccacgttactttaaacggggcgagcagtgcggcagtaattgcccgcttgaaacgggtttttggaattcaaaatttatcaccaatgttaaaagttgaaaaatcaatggaagctgttcaagaaggcgcgctagcaatgatgaaagaacagttaaagccccaaatgacttttaagattaacacccgtcgttcagataaggacttccccatcaataccgatacgatgaaccgggaactaggcggattcattttagaaaactttcctgaaagtcaggttaaaatgaagaatcctgacattactttacgagtggaaattcgttcaaacggaatcttcctaactagcgaagtgattgatggagctggcggcttgccagtgggaacggctggtaagggaatgatgatgctttctggggggattgattcgccagttgccgcatatctaggtatgaaacggggcgttgagatggaaatggttcatttctttagcccgccatacacgagtgaacaagcccttgcaaaagctaaggagctaagcggtaaattagctgcttactccgggaacgttcagtttttgcaagttccgtttgctgaaattcaagaaaccattaaggagaagtgtccggaaggttacttaatgacgatccaacggcggatgatgcttcgtttgaccgtggcgttagcacaaaggcggggtggcttagctatttttaacggcgagtcgctcggccaagtggcttctcaaacaatggaaagcatgatggctataaacgacgtaactaccatgccaattatccgaccggtagtttcgatggataaaaacgaaatcattgaaattgccaaggaaattgatacctacgatttatcaattatgccatttgaggactgttgtaccattttcgctccgccagctccaaagacgcgtccggatttagaaaaagcccgctattacgaaagcaagattgacgtggaaggcttgatgaaacgtgctcttgacggggtgcaagttactaacatccacgctggcgaagaatttttgaaccagaatgaagaagtttttgcagaacttctttaagcttaaattgattagttgctatttggggtgttttgggataaggttaacgtaaatatcggtggatattgagaaatttagtcctcgattagttggctaattaagttatctgacaaagttagtggagaacaatccattttgactagtcgttagaataaaggagcgtaaggtcatggaaatattacgtggtggacaaaaggttgaactagttggtaacccgccagaagtgggcgaccaattaccaaagtttaaagtctttacagcaaaaggcgcgaaagtaaaaacgcgtgatttacttggcaaaccgttgttattaagcgtggtgcctgatttgaatacgcgagtttgcagcattcaaacaaaggcctttaaccagcaggcggataactatccggaagttcggtttgtcacgatttctaataatttaccgcaagatcaagcaaactggtgtgctgccgaaggggttaataacctagaagttctttcagatcacgaattgtcgtttggttatgaaatgaaattatacattccgaatgctggttacttagcgcggagtattttcattgctgatgcatctggtaaaatcgtttaccgggaaatcgttcctgaattacattctgagccaaactacgaagctgcgctagaagtaattaaacaaatgtaaaaacttaattgacgtaccaagatttattctttattattatttttgacggtgatgattaagaggagattttccatcagtgtttttcagagaggggacggggctgcaagtctctaaacacggaagatcgggttgcttatgaaccaatctttaaggcgcagaacttaaagatcgaacagtacgttcgttatcaaagacaaagcggggcagttatgcccaatttaggtggtaccgcgaagcactttcgtcctatttcttaggaagaaagtgctttttattttggaaagggaagtgaagtttgatgaccaaagaagttgagatgtcgacaaagtacgaacctcaaaaggtcgaacagggccgctaccaagagtgggtcgaaaagggtttatttaagcctaatggagataaaaaagcaaaaccatattcaattgtaattccgcctcctaacgttaccggaaaattgcatttaggtcatgcttgggatactacgttacaagatatgttgatccggcaaaaacggatgcaaggatatgatacggtttgggtaccaggaatggaccatgccggaatcgctacccaagcaaaggtggaagctaaactgcgtgaacaaggagtttcccgttatgatcttggacgggacaagttcattgataaggtatgggaatggaaagatgaatatgccgacaccatccatcaacaatgggctaaaatggggctttcgctcgactacggtcgggaacgttttacccttgacgaaggactttccaaggccgttcggaaagtattcgttactttatataacgaagggttgatttatcgtggtgaatacattattaactgggatccgcaggcgcggacggcactttcagatatcgaagtagagcaccaagacgaccaaggcgctttctaccacgtgaagtacttcttcgcagatcctgattttacttttaatgggaaaaattatattgaaattgcgacaacccggccagaaacgatgttcggggacgttgccattgccgttcacccaagtgacgaacgttaccaagacttggtaggcaaggaagttattttgccgcttcaaggccgtcatctcccaatcattgctgaccagtacgtggatcctgagtttgggactggaatggtgaagattacgcctgcgcacgaccctaacgatttccaagtgggtaaccggcataaccttgaacggatcaacacgatgaatgacgatgcttcaatgaacgagaacgcgggcaagtacgaaggcttagaccggtttgaagcacgcaaggcgatggttaaggacctcgaagaccagggctacatgattaagattgacccaattgttcacagtgtgggtcattcggaacggacgggtgtacaagtggaatcccgtttgtcgacgcaatggtttgttaaaatggataaacttgccaagatggctttagcaaatcaagatacggatgacaaggttaatttcatccccgaacgttttgaacacaccttcaagcagtggatggaaaatgctcacgattgggtaatttcccgacaattgtggtggggacaccaaatcccagcttggtatcacaaggaaactggcgaagtttacgtaggcgaagaagctcctaaagatgttgaaaactgggaacaagatcccgacgtactagacacttggttctctagtgcattgtggccatttaccacgatgggctggccggacgaaaacgcggcggactttaagcgctacttcccaactagcacgttggtaaccggctatgacatcatcttcttctgggttgctcggatgatcttccaaagcttgaagtttaccggcaagcggccgtttaaagacgtattgttgcacggattaatccgtgacgaacagggtcgtaagatgagtaaatcgctaggaaacggaatcgacccaatggacgtaattgataaatatggtgcggatgcactgcgttggttcctttcaaacggttctactgcgggacaagatttacggtttagctacactaagatggatgcagcttggaactttattaataagatttggaacgcaagccgctacgtaattatgaacttagaccaagttgataagccacagttaccagcattgaacgaacttaaccttgctgaccgctggattttaagtcgcctaaaccacacggtggaacaagttacccacttctttgacgtttacgacttcggggaagccggtcgggcattgtacaccttcatttgggatgatttctgtgattggtacatcgaaatgagtaaggaaattctcaacggtgacgaccaaactgctcaagtaaatacccaaaacgtattggcatacgtcctagaccaaactttgcggcttttacatccagtaatgccgtttgtaactgaaaagatttggttatcgatgccacacgaaggtgaatcgttggtaacggcggcttacccagttagtcatccagaattaactgacgaagctgctgaagaaggaatgagccacttaatcgaattgattaaggcggttcgaaacattcgttctgaagcgggagctccaatgtctagtcctgtagacctcttaatcaagacggataacgaagcgttggttaagttgtttaacgaaaatcgcgattacattgaccgcttctgccatccagcagaatttgaactagggacaactgtcgaagcgccaaaactttccatgtcggcagtaattaccgatggtgaaatttacattccactagctgaactagttgacctagacgaagaaattgctcgtctggaaaaagaagagcaaaagtacgaacaagaagttaaccgggtggttaagaagcttcaaaacgaaaaatttgttaataacgctccggcagccgtcgttgaagaacagcgaaccaagaagaccgattacgaaggtaagcttgcggctactcgtcgtcgtttggcagatatccgttctggaaaataataataaaaattagtactttaaggttatgggaaccaaatttcccaacctcgttaggattagcgattagaaccgttagtacttgaaaataggggctgagaaaaattacgcgatttttctcggtcttttttaatggcaccgtgataaggaggagagcggatgaattatgaagaggcgctggcatttgttcacgggcggccccggttaagaaaggcgcccaccttaaaaaggatgcaacaatttttaactgaattaggaaatccccaaactaaaatccaggcggtccacgttgctggaaccaatggcaaaggttccacgatcgcctttctaactagtttgttaggccaagaaggtcgtcaggtagggacttttacgtcgccctttattacccgctttaacgagcggattgcggttaatggtcagccaattagcgatgaagcggtggtgcatttagttacccaagtacggccggtagtggaaaaaatggaccaaactgaattgggtggtccgttagagtttgaaattgtcaccgcgatgatgtttttatactttgcgcaacatccggttgacgtagttttggtagaagtaggaattggggggttgtatgattccacaaacgtcttcactccattggtatcggtgattacaaacgtgggctgggaccacatggcacttttagggaatacattaccggaaattgcccaacaaaaggcgggaatcatcaaaccgcacgtcccggtggttactggcgtacaagcaccagaagcgttaacagtaattaaacgggttgctaacgagcagcatgcaccgttaatgatactggatgatgattttaagttaactggtgatcctgcagatttcgaaagcaacgattgccacgtttcaaatataaaaagcgggttattaggtgtttatcaacttaaaaatttagccgtagcaatccaagctgcggtagtcttgagtcgacagcgggggtggaaacttagcgctgatcagattcgcagagccagcttgcaggctcgctggccgggtcggatggaaatcatgcaacaagagccgctagtggtccttgacggagcacataatctaccaggggtacaagcgttaaagcagtcgctacaaacctattggcaggatcgtaccatccatatcttagcggcaattcttgatgataagctatttcagccgatgattgatgaattgttaacgattccgaacgcccaactaacgttaactaattttcaaaatccgctccatcggcaagtggtgcaacccggagaactcgtagccaatgaagcgcggcaaattaattatgaagcgaactggcgaacggcgttacggcaattgattaagcaggccaacccaagggacgtcgtgatcatcaccggatccttgtacttcgtttccgaagttcgcccgttgtttaagaaataattagctgctttttaggtactttgtatctaagaggtggtaaaaatgttattaaaagatggcgcacgtgaaaaaattacaaaaattggcgcagaaaatttgaccaacgcggaattattgcgggcgtttttaagttgttgcggtcaagagcaggcggttaaccggctatcccaagaattttgggatcaggtgggcgatatagtggggtatagtttattaacccaacgagaacggcaaacgattttttcgcaattaccagcggagtcgttagctctagaagccgcaatcgagttaggacgccgcgtccaacgccaaccaatccatctattaggcaaggtgttgggcagtgcgcagattgggaacttgatggtagctcgttttcaaaaaaatccgcaagaacacttggtgttgctttgtttggacacaaaaaaccaaattaaacaggaacgggtaatttttaaaggcgggttaaactctgccgaagtgcatccgcgagaaattatggcggaagttttacggtatagctcgaacggttttattttggtacacaatcatccgagtggaaacgtagagccttccatgaacgacgtggcgtttactaaaaagatgaaaaaaattggcgatttaatggggattcggctaattgatcatctgattgtgggtgaccaaacctattggagtgcggcggaaaatcgagttcttaatgattgttaaacaatctcaattagcgctagtttggccgttttgtgtgttataatttatgaagtcattttaatgagattaattaaggggttcaaagctcatgcataaatttttttctaatcgaaagctagtgttaacggtaatttgtgcaattattgctgcagggttaattacgggatcgttggcattgggaaagaaagataagacaccggccgtccaaaaattgggaaacgacctttttggcgccgttagccgggtgatcgccatccctgcccacggtatgcagacgttatcgactaacttaaataactttgttgcaacttacgaagaaaatgaacgattgcgccaagacattgataaattaagcgcgactcatgctgaaaacaagagcctcaaggaagaaaatcgggaattaaagcaaatagtggggttgaagaactcgatgacggattattctttaaccccagcaatcgtgctgacccgttcaccaagttcgtggcaggacctagtgaccgttaataagggaacggctaacggagttaagaaaaatcaaccagtgcttgccggaaatggcttagttggccgggtagtggaagctaactattcaaccagtaaagtagaattgatcagcgacaataatgaatcggctaaccggtttgcgatccaagtccaggctaaagacggaaattacgttaatggaattattactggctatgacaaaaagaccaacgaaatcattatgggacaagttactgaagataaagatgtggcggttggtagtcaggtaattacttccggtctgggaggcgtaaccccgaagggactctacgttgggaaggtagcaaaagtttcaaaagaagattatgggttagcaaatgaaattcgtattaagccagctgcaaaactgagcaacgttaacgatgtttatattgctaagctagattagggtgaaagtatgttacaatcggcaaaacttaaatatctttttccaattattttatttgggaccttctttttggacggcgccttaaaccaaatattttcggcggttttatttcaatatccgtactcgatgatttgcaacctaacgctgatgtggtttgtgatgggaatcttttttgaaggagagtcccagattaattttacgttatgggcgttcgtgattggaatcgtctttgactggtactatacgggggtctttggggtaaataccttcattatcccgttagtggtcatgtttgtgcgggaagttcgcttatacgtcaatacatcgtttttgatcgtgatggtgcttgatacgcttgcaatggcattgtacaacgtcctattctacgcagttttccaagcgattcatttggcaaacgtgtcggcaagcttttttattgggtattcgtttttcccaaccattattttaaatttggcactcttcgtggttttatattacccaatcaagaccttctttcggcggacccggggaactaattatcggagttttggttaaggagtgcttgacatttaaagaataattgctattattttacttatgtttgacaatgatcagaagagtagtctacgttacttcgaaaagcgacctagggaatggtgcaagcctaggcgaagccgtagatgaaccacatctgtgagttgatagcctgaaaaataactagggttatccggtaattccgttatcatttaagttaatgcaactttctgaggttgactgcgcgagcagttgataaatatgaggtggaaccgcgataattcgtcctcttaggctacagcctaaggggatttttttattttcgcggtagatttggcttcccagtgtactggaaacggtaacgtgggtagttacagctcatttaccaataaaaggtgtttaacttagtgaggttactttgcgcgagcgagtaatgaaaatggggtggaaccgcgattaactcgtcctcttagacaatttagtctaaggggattttttaatactaagggagttgaaaagatgtttaatattcaatacattagcgaaatattgccttcgctgctttctggagcggcgatgacgttacaagtttttatttggacgattatcggttctttaattttgggagtatttttagcgctaggactggtttcgaaattcaaaccgttgcaatacataattagcgcgtacgtttggctaatgcgggggactccgttattgttgcaattaatttttgtcttttacggtctaccaaccgtaggaattatctttccgcgttacgaagcggcgttgtttgcctttatcctaaattacgcagcgtactttgcggaaatcttccggggcgggttgcagtcggtggataagggacagtatgaagcaggccgggttttgcaaatgacctactggcaaacaactaaaaaggtggttttgcctcaggtagccaaaattgtcctcccatcgattggtaacgaagtaattaacctggttaaggattcttcgctagtttacgtaatcgggattggggacctgctccgggcaggaaacgtagcggcggcccgtgacgttaccttggttccgtttatcctggtcgggattatgtacttgattttaaccggaatttgcactttctttttacgtaaagttgaaaaacactattcgtactttcgctaggattgggggaaatcaatatgcttgaattaaaaaatatttctaaaagttataacggacggacaattattgataatttaaacctgcagatccaagatggccatattttaacgattgtggggccgtcgggagcgggaaagactactttgctaaggtgtattagtgggcttgaaaagattgattcgggttcatttctattagatggtaagccgtttaacccgtttgaaacgcgggacagtgagagcgtcatcggggtggttttccaagattttcaactatttcctaatttatcggtaattgaaaacattacgttggcacccatgaacgtgttgcaccttagtgaacgagaagctttacaacgggtggaagaaattatcgatcgactaagcttagctaaaattattaatcaatatccctaccagctttcggggggccaaaagcaacgggtggcaattgcccgcgcattggcgatgaatccccggatcctttgctacgatgagccaacttcagcgcttgatccagaacttcgggatgaagttagtcggatgattctagacctgaaacaaaatcaaattacgcaagtcatcatcacgcatgacattgaatttgctgaaaaaattgctgacgaaactttgactgtaaagccggtgaattaaatgaaaaagttagtaaaatttagcttactcgtgatggcctgtgcgctattaattccaggattagcagggtgcggaaaaactgcccaaaataatccccagccaagcagctggaaaagtattcaagctaaacaccatgtggtaattggcttggatgatagcttcgtgccgatgggctttcgccaaaaaaatgggaagctggcgggatacgatatcgatttagcccgcgccgtttttaagcaatatggaattaaggtcgattttcaaaccatcgactggtcgatgaacgttactgaattacgtaaccaaaccgttgatttgatttggaacggactgacgattaccgatgaacggcaacgggcaatgacctttagcgagccctacttggtcaaccaacaggtattggtagtgaaaaagagtcagcatattcactcaccacaggatatgactggtaaaacactaggggttcaaagcggctcgtctggggcccaggacattgaccgttacccaaaacttttgaaacagcgaattaaaaagcatactcccgtactttatgatacgtttaacaacgcttttattgacttgaaggccgaccggattcagggcttgctgattgatagtgtctatgcaaattactacctgcagcatttaccaaatccaggtgactaccgggtgattaagagtggcatgcctaacgaatattttgcggtgggcattaaaaaaggcaatcaagaggtcaaacaaaaaattgaccaaggaattgaacacttacgtaaaacgggagaattacaacgaattaaccagaaatggttcggtaagtaatggcattcaagctggaaatttagcgatttccagcctttttgatacactgaaagaacaaagaggggttaagggaggaagcgccatgcttttagctagtgtagtgggatatttattgaacttattgtttgcctttgggattgcgttaatggaaaaacgggacatttcagccgcgtgggcctggttactggtaattgtgttgttaccgggaattggcttgattatttatttgttctttggctggaaattaagtcagcgacaaatttttaatttaaaagcgcaaaagcatttgggaattagtgacatggcggatcaccaaaagcaaagcacccaaaatcgggtttcgttgtctacgaccctcgaaaatgacttagtaaccatgtttttaaacacggacgacgcgattttgaccagtcaaaatgatttacaaattttaaccgacggccaggctaagtttaaaaaactttttcaagatttaaggggtgcccaacaccacattaatatcgaatacttcaccatttacgatgatgacttagggcaccagttacgggagattctcgtggaaaaagcgcgcgaaggggtgcgggtccgggtgctgtacgatttatttggttcaaaaggagctaagcaaaagttctttcggccgttgattgctgctggtggagaagttaccccgtttatgcgctctaaatttggctattatagttttcggattaattttcgtaatcaccgcaaaatcgtcgtaattgacggttcaatcgggtacattggcgggtttaacgtgggagaccagtacttaggcaaaaatcgtcgttttggcaattggcgtgatacccacttgcggttggtcggctcggtcgtgttacaattacaaagtcggttctttatggattggaacgcgtcggttaccgatcctaagttaacgtttagtttgaattatttcccgcaaaccgcgttggaaaagaagctgcctatgcaaattgtaagcagcggtccagaaaatgacattcaaaagattaagcagggctacattaaaatgattatgggagccaaacactcgatttggattgagactccgtacttcattcctgacgatgcacttatggaagcactcttgattgcgctccgttcggggattcaagtttggatggtgattcctaaaatgccagaccatcccttcgtatatcgggcgacggaatattacgcaaagcaattattagcagcgggagcacgagttttcgcgtaccaaaaggggttcatgcacgctaagacgatcgtggtggaccaatcaattactagtgtgggttcggcaaattgggacatccggtccttcaagctaaactttgaagcaaatgcatttatttacgacgcaaaagttgcgcaaaaaatgatcgccattatgaaacaagacgttaaggatgctcgtgaactcgatgaacagtattttgcgagtcaatcacgatggaagaagtttcgccagctagccagccgaatgattgcaccaattttgtaagtggaacttaaggcaaagaaatcggattacttataaagcaggtaaattaggtggcaaattttttaattgaatgaggcagtaaaaaagcgaagaagcattgatatttcaatgctttttcgctattattaatcgcatgtgaaaaggtaggaggcgtcatctttggacgtacaaatgcggcctggagttcaggctttaattgttccaagcaagaagtttaaaacggtacggattgacgtacattttttaaaaaacgcaacggtagcggagttagctcctcgaaccctggtggcgaatcttttagagacgagcacccagcgctatgttaaccaaatccaatttacgcacgccctgtcagcaatgtacggggcgagttttggcgtgggggcaggtaaaaaaggcaacctccatgacattggattttcaattacggtggctaatgatcactacacgggcggtcagtccttagtgcggatggctatcgaattcttaaacgaggtgattagtcacccgttggctagtaacgggcgctttgacgagcagacgtttgcccgtcaaaagactaatttaattaattacgtggattctgctactgaagacaagcagttttgggcgagtcagcagcttcgcaagttggcttttggagcaaaccggattcaaggggtccctagttacggacgtcgggcggatttgcagaatttacaaaacgaacaagtctacgccacgtatttatccatgctgcgtcatgacttagtacatattagtgtttcaggtgacgtcgatgaacaaaaagtgttagaagatttggcaattttagaattacccgagcggaaagttcagttaggatcggtaattacgaagtttaattcgttgccaaaaccgcgtcatagagtggcaaatcaagcagttcaacaagctcggttgaacttggcctatgatattccagctacggtggtgagcgataattttcacgctgccgttgtttttaacgcgctctttggcggctcgccacaatcaaagctgttccttaacgtgcgggaaaaagctagcttggcatactatgctagttccagcttagatttgtataacggacttttaaccgtgcaaacgggaattgaagcaagcaattacgctcgggccaagcaaatcattcaacaacaaattatagatttacaagcggggcagtttaccgagagtgatttaaccagcattaaagctgggctgcgttcagattacctcgctggtttagacttacaacgtacgattcaccgtcgggggcttaacgaatatctacttggtttccatcgcccagctgagcaatggttaaatgatttagaccgggtcggggcgacccaaattgttgagattgctcgacaactcaagccacgagcggaatttttcttaaatggggataatgactaatgcaaataaaggaaaaggcatattcggtttttgacgaacgattattttcggcaacgttaactaacggcttacaaattaatattttgcctaaagcggattttcaaaaaacgtacgccgtttttaccactaacttggggtcgatggatcgcaattttcgggttggggaacaaaaactacaaattccagccggaacggcgcactttttggagcataaactttttgaaaaagccgactacgacgcttttcaaatttttacgcgaaacggagcggattcgaacgcgtttacaagctatagcaagactagctacttattttcagcaactagccggctgaaagagaacttgacgactttactagattttgtgcaggatccgtacttttctagtgcttccgtagctaaggagcaggggatcattggacaagaaattcagatgtataatgatgatgtagattggcaattatacatgggaatgatgcgtaacctatttcccaaacaagcgttaagtgaagacattgccggaaccagcgcttcaattgtgcagattacgcctgaattactgtataaggtccaccaggtcttttaccatccccaaaacatgcacttgttcgttactggcaatttagatccgcaaacggtcgtcgactgggttgaagaaaatcagcgccaaaagcagtttacagaatttgttcagccggttaatttgcaaaaagctgaacaaaagatccttccggtagttgagcaaagctcggcagtttacctggctaaccgccctaaggtaatgttgggaattcgaaataatcgttacttaccagctccggggctggaacgcttaaagtacttattgaccttagatttaggtttatatttactattaagctcttcttctaaaaattacttaaaattatacgatgaaggacttttagacgatactttcggttatgatttaaataacgagcgggacgaattatttttgacgatgggtggcgacagcgaccatccccaacaattagcagctgccttgaaggaaattttgcgtcagggacttaccgataccccggagctggcagcagattttgctttggctaaaaaagaaatgtacggtcggtgcattgcccggatgaattcattagaagcaattgctaattcttttgaaggggctctttacggcaatgccactatctttgacgaagcgcagatgtttaaggagatctcccttacagaagtgattgaagcgctaggccaattcgttagtgaacaagtaattagtagttttgaaattaaaccaaaataattaagtaggcgagaaaatgaagtttgcgttggtatgtggagcgagtggaaacattgggatggcaattagtcgacgattagctaaacaaggctggtccttatatttacattaccaccagcacgctgcagcggtagaagaattagtgcaagaattacagcggcaatacccaaaacaagacttcctaatggttcaagcagattttcgaaacgaagcggcggcagaggaaatcggtgcgcaaatttttagcttggacgcgattgtttttgcacagggaaccacgatctaccagttgttcgatgaatttgacggtacccagttagaaaatttatggttagaacaccttaaagttccgttattggtaattaaaaaattagtttctaaactggcagaaggcggtcacggacgaattgtctttattggctcgatttatggggcggtgggcagcgccatggaagttccttacagcatgttaaaaggggcaatgagcagttttgcaaatgcttatgctaaagaggtggcttccttagggattactgttaacgtggttgcaccaggagcagttcaaacacagatgaacgctaactttgcggaagatgaaattgaagcaatcagtgaagaaatcccggtaggtcggtttgctaaaccagacgaaattgcctacctagtggaaactgttttagccgaaacggcgtcatacttaactggtcagaccatttatgtggacggcggctggcaaaaataatggtatactggttgttgatttaaaataaattggggtatttttatggggacgaaaaaatacaaagtaattgggatgcggttgcaagatgcccgtctcaaaaagggttggacacttgacgaagttcaactaaagttacaaatttctaaacgatatttaatggctttagaagctggtgaagatgatgatttgccaggagactattacacccagtcgttaattaagcaatacgcgaatttactaggggtggaagtgggcaaccgtcatttagaaaatgagcccgaaagtatcaaggaatggcgacgaactcatggagaagttactagccgtgcgcaaaaagaacttcaacaaaagccgtcggtactgagcggcttaattcatcagcacccgtggttgatgggaattattttagttggggtgatatggttattagtttgggcagcctttagtgagatggctaaccgttatccgtcacaattagtcgcacaaaaaaatccgacggtgattgataaaactaaaaaaagccatcataaaactaatgcaagtaaaaccaagtctacgcatcctagtgctaaaaagcaatctaagcaaaccacgacaaaaccgaaaatcgaaaaggttaatgacagtgtagataatttgcgggtggccttgccggacgaacaaaaacacgccacgcttaaactcaagactggcgataaccaatcttggaattcgttaacagcgacggctccccaagcggctaccgttgctcaaggagttatggaagctcaccaaacccagcactttaagttgaaaaagggctatacatacgttttgaaaattggaaatacaattggattaaagggtagtatcgggggacgtaaaatgcctgatcctgctacgggagtcacggtacggagcgtgaccattgtcgttaattagaaaggagaaaacatgaacttaccaaataaactaaccgtttttcggattattttaattccgatttttatcatcttgaccgttatgccagaagtcggagggagcgtatggtggttgggaaccccgattgccatcactaaaatttggggagccgtggtttttgcgatagcttccatcactgattttcttgacggccaaattgctcggcgccaacatttggtaactaatttcggcaaatttgctgatccgattgcggataaaatgttagtaatgtcggcgttcatcatcttggtgtccatgaaaatggctccggcgtgggtggtagccatcattgtgtgccgagaactagcagttagtgggttgcgattgattattgtagaaaacgaaggggaagttttagctgcggcgatgcctggtaaaattaaaaccttttcccaaatgtttgcaattattttcttgctattgaacaacttatttgcaaactatttgcactttggaccaggaaccgttttactttacgtatgcttattctttaccatttattctggaattgattatttttaccaaaaccgctccatttttgcggattctttttaaaacaaaggctagtggaaaaactaacggaagcgaatcagtttagcttcggaaggtttggaaacagcctttttttgctgaaaaagttaaaataaagcagtaagattagcgtagttatataatgaggaggaagttagtagatgaaggcggaaattatttcagttggtaccgagattttgttaggtgaaatcaccgatactaacgccgtttatttgagtcagcaattagcccagctaggaattgacgtttaccaccaagcaacggtgggcgataattcaactaccatgaaggaaacgctggaaattgccagcaagcgcagcgacttagtgatcaccattgggggattaggaccgacggaagatgatattactaaaccaacgttggccgcgtttttaggtgaagaattagtggttgacgaccgggcgctagaaaaggtgcacgagcactttactaagcaggggcgtcccatcactcccaataatgaacggcaagcgttgttattaaaaggaagtcgtccggtgcaaaatcccaacgggttagcgattggcttgtttgccactactccgacgaccgattacttggttttaccagggccgcctagtgaatttaagccaatggttaaccaggaagtgcttcctttgttaaaagagcggtactcgttggataaaacaattcaatccaaaacgttacacttcgtaggggttggggaagccgacttggcgacccgggtggatgacgtgatcagacgacagagtaatcctacaatcgcgttatacttcaaaccgactgacgtaaccatccgactaactgcgaaggcggattctaaagatgaagcagaacaaatgttagaaaaaaccaaggcagaaatccttgctcgagcaggcgattattactatgctgaaggcgaacaggtcgctttttcagattttgtagtacaagaattaatcaaacgaaaactaacgttaacggcagcagaaagtttgactggtggtgctttccaaaatcaattagtagaaacagcgggtacttccgcagtattttcgggaggctttgtaacgtattctgatgaagtaaaaactagtttattgggggttcgtccggaaactatcgctcaatacacggtggtaagtcgtccggttgcggaagagatggcccgtggggcacaaaagcaattaggtacggacctagcgattagctttactggagtagcgggacctgaaggattagaaggacacgcgcctggtgacgtatggattgggttggcgttgccagatggaagtaccgtggctaagggattccattttagcggtaaccgggaaaaaatccgccatttagcagtaatgaatggttttcgaatgatttgggaacaagtggttaaataatatcgaacttttgttcgctttttgattgcttttttggagattactaggtattatatttagtatagatggttaagggcgacttcgggataattttaaattttaatcaacgagaagcgtcggccttaactggaaacgtgcaatataagacccattaggaggttattaattaagtggcagatgaaagaaaagaagctttgaataaagctcttaaaaaaattgaaaaaaactttggaaaaggttccatcatgcggatgggggatgcggttgatacgcaaatttccaccattccaagcggttcgctagcgctagacgatgcgttaggtgtaggtggttatcctaaaggacggattgttgaaatctacggtcctgaaagttcagggaaaactacggttgcgcttcacgcggtagccgaagttcaaaagcgaggcggaacggctgcgtacattgacgcggaaaacgcaatggatccagcttatgcaactaatctgggagttaacattgacgacctcttactttcccaaccagatactggggaagaaggtttggcaatcgcagacgctttagtttcaagtggagccattgacttagtagttattgattcggttgcggccttagtaccgcgtgctgaaatcgacggtgaaatgggcgatgctcacgttggtttacaagcacggatgatgtctcaagcgctacggaagctttcgggttcaattaataaaactaaaacaattgcccttttcattaaccaaattcgtgaaaaggttggaattatgtttggaaatcccgaaaccaccccgggtggccgggctttgaagttctatgcaaccattcgtttggaagttcggcgtgctgagcaaatcaaagacggttctgacgtaattggtaaccgggttaagattaaagtagttaaaaataaggtcgcacctccgtttaagcgggcagaagtcgatattatgtatggtgaaggaatttcgcaaacgggtgaaatgatcgatatggccgtagaaaaagacatcgttggcaagagtggttcctggtactcatatggtgaagaacgaattggacagggtcgtgaaaatgctaagaagtacatggaagatcacccagatgtccgtgccgaggtattggctaaggttcgagaagcgtacgggatggtagctgatccagctagtgaagttaaggaagatagcaaacaagacgaccaagctgaattagacttgaaataaaggtaaatatttatggggagaaaagaagttgggatagttccagcttctttttctacgttatcagtaattgaaaaagacctgtttaaactaataatttaccaaacccttaaaggagtacgtagctttcgcaaagctaacactaatcagcgttgggcgctaaagacttattgacacgcttatggctaaatattaaaatgattataagtgtgagaatcaaataacatcattcaaagattataactatggtcttgatgatttggaggcaaagatggtaatttattatattatcctcgcaatcatcgctatagttgttggctattgtgcaggatacatcatgcacaagcggttcattgaaaagcaaactgcagatgctagtaattcagctgatctaattattgaaaatgcgcgacaacaagcggaaaccgaacgtcgggaaaagcttttggaagcaaaagatgaaagtcatcgttatcgtgcgcaggttgaaaaagagcttaaggaacgtcgggcggaattgcaaaagcaagaagaccgacttcttcaaagagaagacgtccttgatcgtaaggatagttcctttgaaaagcgcgaaaacagcctagaacgtaaagagcagaaactagctgcagatcaaaagctaattgatgaacaacaacaaaaagcatcatcactcgttgaggaacgacaacaagagcttgagcgagtttcaaatttaactcaagaagatgccaaaagtttaattatttcggaagtgaaagccaaacttgaaaaagaacgggctttgattatcaaagaaagtttagaagatgctcaaaaccaagctgatgaaacagctcggaaggtaattgcgcaagcgattcaaagaagtgctgcagatatggcatccgagaccaccattacggtggtttcgctaccaaatgacgatatgaagggacgaattatcgggcgtgaaggccggaatatccgtaactttgaaaacgtcacgggagttgacttaattattgatgatactccggaagcggtcgttttgagtagttttgacccgattcgtcgtgaaattgcacacattgctttggaaaaactgatccaagatggccggatccatcctgctcggattgaagagatggtggaaaaggctaagaaagaattggatgacaccattcgcaagaccggtgagcaagcagtatttgagcttggtattcattcaatgaatcctgaattgattaagttaattgggcaattaagatatcggacgagttatggtcaaaatgtattaaaccattctattgaggttgctaatttggcaggagtgttagctgctgagttgggtgaagatgttactgtagcaaaacgcgcaggattattacacgatattgggaaagcggtccaacatgagaccgacacttcgcacgttgaattaggtgtggaattggcgaagaagtacaaagaaagcgcggtcgtcgttgacgcgattgcgtctcaccgaaacaataacgaagcaaatcatgttatttccgtgttagtggcggctgcggattcgatttcagcagctcgcccgggagcacgtagcgatacattacagagctatatccatcggttagaaaagttagagcaaattgctaaccaatttgatggagtgaaaaagagttatgcaattcaagccggacgcgaggtgcgggtaatcgttaagccaaccaagattaacgacttaaaagcggttatgttaacgcatcaaattcgtaaagcaattgagaaacaattagaatatgcaggcaaaattaaagtaacaattgttcgagaagttcgcgccgttgattttgcaaagtaaggagttgggccattgtggacccgctctttttttatatggtgcatatgatagaatagccattgttaaactaattttttacgtatttgtaattaactgaaaaattaagagtcggaaggaatgcaaaatgccacaaaagacaagtgatacgccaatgatgcgtcaatatatggaaattaaaaaccagtatccggatgcttttttattttaccggatcggggatttttacgagttgttttacgacgacgccattaagggttcacaactgctagaattgacgcttacggcaaggtcgaaaaatgcggacgaccccattccaatgtgcggagtgccgcatcatgccgccccaaattacatcgacattttagttgaccaagggtataaagtggcaatttgtgagcagatggaagaccctaaggccgccaaaggaatggtgaaacgggaagtgatccaactcgttaccccaggtaccactacggatcaaaaggcggaagacgctaaggaaaataactatttaacggcagtgagttttgacgctgcaactaaaaagtacgggtttgcgtacacggacctgtcaaccggtgaattgaaggtcgcaattttggacgatattgagagcgtggtcaacgaggctgtaggattacggacccgtgaaattgttgcggaccagtattttgtggagcactttggggaacgttttaaagaattaaacattttagtttcgcaacaaaatgacgtcgaaatctcggcagaattaagttatttaattcaagatttgacgtccccaattgccgtgcaagtggttaaacaactattaatgtacgttcaagttacccaaaagcgcaatctggcgcatatgcaaaaagcaattgcgtacgaaccatcgttttacttacgaatggaccatgcgtcaaagtataacctcgagttaactcgcttaattcgaacggggaaaaaacaaggaacgctattatggttgttagatgaaacgaaaacggcaatgggaggtcggttattaaaacagtggctggaccgtccgttaattcgtaaggacgctatcaatgctcggcaaagtcgcgtgcaggttttattagaacacttttttgaacgaagtaatttgcaagaagagttaactaaagtttacgatctggagcgactagctggccgggttgcctttggaaacgtgaatggtcgggacttaattcaattaaaaacctcgctattgcaaattcctaaaattcggcacgtactagcggaattggacgaccccgttttcgacgaggcccttacgcggttagatccggttagcgaaattgcggacttgattgaagcagccattgacgaagatgccccgatttccgttacggaaggtaacgttattaaagatggctataatcccaagttagacgagtatcgggacgccatgcggaacggtaaaaaatggattgctgacttacaagcccaagaacgccaagcaaccggaattaaaaaccttaaaattggctacaacaaagtgtttggctactacattgaagtcacgcgggctaatttagctagcgtaccggaaggacgttacgagcgtaagcaaaccttaacgaatgccgaacggttcattactcccgagctcaaggaaaaggaacgaatcatcctagaagccgaacaaaagtcgacggatttagagtacgagttgttcaaaaagattcgagaaacgattaaagagcaaattgaacgtcttcaaaaccttgctaagcaggttgcagagttagacgttttacaaagttttgcggtagttagcgaagaataccaattcgttaaaccaaccatgacggaatcccatgaaattgaaatcaaagccggccgtcatccggtggttgaaaaggtaatggggcatcaaagttacgtccctaacgatattttaatgaatcaggatacggaaattttactaattaccgggccaaatatgtctggtaagagtacttacatgcgccagcttgcgttaaccgtcattatggcgcagatggggtgttttgttccagctgagaaagctacgttaccaatttttgaccaaattttcacccgcatcggagctgctgatgatttaatttctggccagagtaccttcatggttgaaatgcaggaagctaaccgggcgttaaaggacggaactgcaaacagcttgattctctttgatgaaattggtcgggggaccgcaacctatgatggaatggcgttagcacaatcaattattgaatttattcatcaaaatgtgcatgctaagaccctgttttcgacccattaccacgagttgacggcacttgaccagacgctgacacggttgaaaaacgtgcacgtcggtgcggtagaacaggatggcaatttagttttcttgcataagatggaagacggccccgcagacaagtcatacggaattcacgttgctaagttagcgggaatgccggattcattattggcaagggcatccgtaattctagaacagttagaaaacgaaaaccaaggtgatgctgcaaagctaaccgcaagtgaaacaccacaaccagtttccaccgcttctcaggctgcggagacgcaaccagctgaccaatccagcgcggaggaaagttcagtaacaagctcttcgcgggaggttgtagaagaacaaatggcgctctttgacaccactccagcgcaaaagaaaacgaaccagttacaaacgcaagtagtagaacagctaactaacctaaatttaatggatatgaccccgatggaagttatgaatcaattgtataagtggcaaaagaagctacgaaaatgaggtgcggataaatggcaaaaatccaagagttaagcgatattttagccgaccagattgctgcaggagaagtagttgaacgaccggcttcggtggttaaggaactagtagaaaatgcaatcgatgcgggaagcagccgcatcgatattctcttagctgaatcaggattaaaaatgatccgggtgattgacaacggaagcgggattgagggtagtcaagtagagacggcctttaaacggcatgcaactagtaaaataacttcgcgtgccgacctgtttcgggtggggaccctcggttttcgaggcgaagcgttacccagtatcgcatcaattgcggatgttaaaatgacgtcttccacagccgaagggcccggtcaattcgtgcattaccggggcggagaactaatcgagcatcgggaggcccaaagtcgacagggaaccgatattacggtcagtgacttatttttcaacacgcccgcccggttaaagtacctaaagtccttggcaacggaactatcaaagattaccgatattattaaccggattgctttgagctatcccgagattgcgttttccttacaaaacgacgaacggcaattgatgcgaacgtccgggcagggcaacgtccaacaagtattagccaatatttacggcacccataacgcccaaaaaatgttagatatccacggggaaagcgtcgattttcgcattgacggatacgttagtttgccggaatttacccgagctaaccgcagctacattactattttagttaacggacggtacattaaaaatttccatatcagtaaagcaattattgaaggttacggctcaaagctaatggtgggacgctatccggtggcggtaatcaatattcaaactgacccgctattggtggatgtgaacgtgcacccctccaagctggaggttcggattagtgaagaaaatgccttaacggagttaattagtaaaacaatttttgaccggttagcggaccaaaatttgattccggatgctgtagataacctgaagaaaaaacgaatttctaagccagctggtgagcaactagacttaactgaaactgtactttcgggttcgtttggtaagggtaaggacacgcctactgaatcagctgctgtggaaggggatgattccgcagcagcattgcacccctccgttgcggctactaagccaattatcattagcacgcggcaagacttgcagtcggatcggattgcagaatttaaagaaaaatatgccgattcaactacgcccgttactaaaaatgagaacacggaaggtgaagagaaaactcctagcacaagtcgttttcctgctttaacgtacattgggcagatgcatggaacctacttgtttgcggaagcggacgacggtttatacattattgatcagcacgccgcccaagaacgaatcaattacgaatattatcgggttcaaattgggcaagttagcgatgaccagcaagatttattagtgccaatttatctagattattcgacaaccgacacgttacgcgtcaaggaaaagcaatcggtcttagaagcgtgtgggttataccttgaagagttcggccgaaatacgtttattgtccgtcaccacccgacgtggtttaagaagggacaggaggaagataccgttaaagaaatggtggattacgttttgaacgaccgaaacatgacggtagctaagtttcgggaagcaactgcaattatgatgagttgtaaacgggcgattaaggctaaccaccatttagacgatttacaagctaaacagttattgaaggatttggcgaaggtggaaaatccgtttaactgtcctcacggccggccagtgctcgtacatttctccactacggatatggaaaagatgttcaagcggatccaagatccccataatacaaacttaattgacgaagacttatgatacaattattaatacgaacaaacgttttgaaatggggattaaaagatgtatgaatatttaaatggtgtcgtcgtggatatcaatcccgcctacatcgtaattgacgtgaacggggtcggctacttggttaacgtagctaacccgtatagctttaaagcagatgaaaagcaaaaggtttacgtgcatcaggcggtttcagagactgaaaacacgttgtacggatttaaaaaatacgcggacaaagagctctttttgaacctgctcaaggttaagggaattggacctaaaagtgcgctggcaattttggctaacgatgatcaccagggctttattcgggcggttaacagcgatgacgttaactacttgaaaaaatttcctaaaattggtcccaaagcggctaagcaaattattttggatctgaagggcaaaattacgagcaacgaacctagtggcccattatttgaaatgccgactactactaacaatacgttagatgaagcgatcgaagccttagcagctttagggtattcagaacgcgagctaaaaaagattacgcctaagttagatgagcttaacaaccaaactacggaccaatacatcagtgcaggattaaaattgttaatgaaaggatagcgtgtgattaatggatgatgaacgaattacgtcttcggccgttcagggagcccaagaagaggctaacgagcaatcgttacgcccccagaacctaagacagtacattggtcaagcccaaattaagcatgaactgtccgtatacattgaagcggcaaagaaacgtgaagaagcgttggaccacgtactgttgtatggaccaccgggattagggaagaccactttagcaatggtaatcgcaaatgaaatggcagtccagattcgaacaaccagtggtcccgcaattgaaaagccgggtgatttagtggccctcttgaacgaattacaaccgggtgatattttatttattgacgaaattcaccggcttcctaaagtagtcgaagagatgctttattcggcaatggaagatttctttgttgacatcgtggtcggacaaggacctacggcacatccgattcactttcctctgccaccgtttacgttgattggggcaactacccgggccggattgctttcggcgccgctgcgggatcgcttcgggattgtagagcacatgaactactataccgaagatgatttagcgaacattgtcaaacgatcggcggaaatttttaaaacaaacattgacgatcagggagctcacgaaattgcccgtcgctcacggggaactccccgaatttcaaaccgtctcttaaaacgggtccgtgattttgcggaagtggaaaatgatgcccatatcgaccgcacgttagtccaaacctccttgaagttgcttcaggtggatgatcgggggttggatcaaaccgataaaaaggttctcaccacgatgattgaactatacggtggggggccggtgggattaaccaccattgccgctaacattggtgaagagccggatacaatttcggaaatgtatgagccatatttattgcaaattggctttctaaagcggacccctcgcggccggatggttactgagcgcgcatacgctcatttaggattagaaaatttatatatgaataaatgaggaatggaaaaaatgacattaacaaccgaagactttaactatgatttaccacacgaattaattgcccaaactccgattaaaaagcgggacgcttcccggatgctggtattagaccataaaactggcgaaatggcggataaacatttttacgacattgttgaccaacttaatccaggagacgcgatcgtaatgaacgattcccgggtcatgccagcacggatttatggggtcaaggaagaaactggcggccacctcgaagttttactgctgcacaacattgaaggcgaccgttgggaaacgttggtaaaaccagcgcgacgtgccaaagtaggtaccaagattacgttcggagatggcagtttaacggcgaccgttaaaaaggaacttgaccatggcggacgtgaaattgaatttgaatacgatggcatttttatggagattttagaaaaacttggagaaatgccattaccaccatacattaaagaaaagttagatgacccagagcgttaccaaacggtttactcaaaggaaccgggttcagctgcagcacctaccgcaggactgcactggactaaggaactacttcaaaaagttcaagataagggcgtcaagctggtttatctaaccttgcacgttgggttaggaactttccggccggttgatgaagaaaatattgaagatcataagatgcatagcgaattttaccggttatctgaggaatcagccgctactttaaacgaagtccggaagaacggtggtcgaattattgctactggaacgacatcaattcggactttggaaacgatcggtactaaatttaatggtgaaattaagccagatagcggttggaccgatattttcattaaaccaggttacgaatggaaagtggtcgacgccttcatcactaatttccatctaccaaagtcaactttagtaatgttagttgccgcatttactggtcgtgaaacgattttaaatgcgtataagcatgctgttgaagaaaagtatcgcttctttagttttggcgacgcgatgtttattaaataaataacgaatggagaatactgtggaacctgcaatcaaataccgactaattaaaaaggataagcataccggtgcccgactgggagagattattaccccacacggcacttttcctacaccaatctttatgccggtaggaacgcaagcaaccgttaaagcaatgtcacctgaggaactagaagacttgggtgcggatattatcttgtcaaacacttaccacctctgggtccgccctggtgaagacatcgtcaaagaggcggggggcctgcatcaatttatgaactggcacaaggggattttgacagattcgggcggcttccaggtattttcactagcgaagctgcgcgacatcaccgaagagggggtccattttcgaaacgaaattaacggtgcgaagatgttcttgtcacccgaaaaggccattcaaattgaaaatgatttaggccctgacattatgatgagtctggatgaatgcccgccattttttgaaagttacgactatgtcaaacattcggtagctcgcacaagtcgttgggctgaacggggattaaaggctcatcgtaatcctgatacccaaggattgtttggaattattcagggagctggctttgaagatttacgtcggcaaagcgcccatgatttagttagcatggatttccctggatactcaattggggggctttcggttggagaatccaaagcagaaatgaaccgggtgcttgaatttaccactccattaattcccgaaaataaaccgcgttacttaatgggagtgggatcgcccgacgcattgattgatggagtaattcggggagtggatatgtttgattgcgtattaccaactcgaattgcccggaacggaacctgcatgaccagtcacggacgactggtagttaaaaatgcgaagtatgcgcgagactttacgccaattgatgagcagtgtcactgctacacttgccggaacttcacccgcgcgtacgtgcgccacctcttaaagacggacgaaacttttgggctccggctaaccagcattcataacgtttacttcttagtacatttaatgaaggacgttcggcaagcaattatggacgataatttactagagttccggcaaaacttctttgacgagtacggttacggcaaagaaaatagtaagaatttctaacaccactggtttagtaggtatatttttggtacagttaatataaatgaattagcgaggtgaaaaaatgttattagcagccgcaaatggtggttttgggatgagtacgattgttttcttcatcttgatcttcggtttaatgtatttcatgatgattcgtccacaacgtaagcaacaacaaaagcgccaagaaatgatgaaccaattaaacgttggtgatgaagtagttacaattggtcgtttgcacggcgtggttgattcgatcgacaacgaagctaagacggttacgttagattgtgacgggatttacttggtatttgaccgaatggcaatcatgcgagttgaaaagaagcaaaacgttgccccagcatcaacaactgagccaactaatgcagatacaactgatgatgaaaaatctgattcaactacggaagaaaagtagttttttaaaagctaggagcgctcgttaagtgggtggaatcctagctttttatagtctaataatattcacgagcactttattagcaagacgttggggcaaagaagttcttagttaattaatagttgggcaagcggacaatgttttgcatgcagcggaatgtttttacttgttcggtgaggcaaactgattcataatataaaacattgaagactgaaagtgaggagtcaaaaatggagcaaaaggcattatttattatttttggtggtacaggggacttagcttaccgcaagctatatccggcactttttaatctatatgaaaaagggtatttaaaagaaaactttgccgtaatcggaactgcccgccggccgtggtcaaatgatcattatcatgaagtagtcatgagtgcgattgaggattcgggtcgagacgcggggcggacgaatagtgaactgcctcgtaaatttgctagccatttttattatcaatctcacaacgttgatgatgcagaacattacgtagctttgcgtgatctcgctgatcaattagacgaaaagtatcaattaaacggaaaccggattttttatttagcgatggcaccccgtttctttggcacaattgcgggccatctaaaggaccaaaaactcttgactgaaggatcaggttttaaccggttaattattgaaaagccgtttgggcgagattatcaaagtgcaaaggaactcaatgattcaatttctgggtcgtttgacgaagaacaaatttttcggattgaccactacctaggtaaggaaccgattcaatcaattgcgggacttcgctttggaaatgccttatttaactcgttatggaataaggaacatattgacaacattcaaatcactttagcagaatcactgggggttgaagaacgcgctggttattacgaaacggctggagcaatgcgggatatgttgcaaaaccatatcatgcaaatcgtgtcgttattaactatggaacggccggaagtatttgattccaaacatttgcaagacaagaaaattgaagccttagaaaatatccaaacgtacagtaaggaagaagctgcgcagaactttgttcgtggtcaatatggtgaagatgttgcgcatacccaattagcctaccgtgaagaagaaggaacggcggatgattctagcattgaaacctttgtagctggaaaattaattacccacaatccttctttagatggggtgccaatttacgtacggacggggaagcggttggcaaagaagtcaacgcaaattaacgtggtctttaaaaatgacgaccaggatattttcaatagcgaccctaaccaaaaactagaaaccaacgtgttgaccttgcatattgaacctgaccaaggatttacgctgcaattcaatactaagaagggtaatcaaggttaccaactttcaccagtgcacttacgctaccggaagtcagcttcagaaaaggctaaaaccccggacgcatacgaaagtttaattcgggacgccttaatgggtaataaaactaactttgcccactggcacgaagtccgtaaagcttggcaaatcgtggacgttattcgtcaggtttgggatgctgaaactcctgatttccctaattacgcaagtggcagcatgggcccccaggctgcggatgacttattagttcgggacggccggcaatggatttttaacccccaaaaatagccaaggtgggaggtgaccgttttggcaaaccaggtgtcaacgccgctaataattgatgattctcgaaaaattattcatgttgacatggacgctttctacgcttcaattgaaatgcgtgatcatccagaacttcgtattaaaccgctagtggtggcccgcgatccccgaaagactggcggtcacggggtggtggcaacggctaattacgttgcccgtcagtcaggagttcattctgcaatgccagctgctaaagcgttagaactatgtccccaagcggtttttaaaactcctgattttgaaaaatatcgggcggtgtcggaccaaattcaccatattttccacgaatttaccgataaaattgaaacggtcgccctcgatgaagcttaccttgacgtaaccgatgataagaaggggatgcaagatgcggtactgattgcccatgaaattcaaaagcgaatttttaaccatactcagctgacctgttctaccggaatttcttataataaatttttggcaaaaatggcgtctgaatatgctaaaccagtcggggtggcaattattgaaaaagatgacgtcggagcgtttttaaaagaaatgcctattgaacagtttcggggagtcggcaagaagacgatccctaaaatgcacgaattgggtgtgtttaaaggcgcggatttattaaaactaagcgaaaacgacctgattcaccattttggtaaatttgggtatacactctatcgacgagtgcgggggcaagacgaccgtccggttgcttaccagcgcgaacgaaaatcaatcggtaaagaagagacctacggcaaaccgttggtgacggaaaacgaagtcgaccaacggcttcgcttaattgccaagaaactagctcaagcggttaccaagcgacaaaagcatggtaaaacgttagtcttaaagttacggtatagtgattttgagactcttactaagcgaatcactcgtccggaatttttaccaaccgatagtgagacttactacttttatgctaagcagatttttgacgagattgctgatttttcgcgtgggattcgtttgctgggaatcaccattaccaacctttctgatcagagtttccaagaagtttctttaccgctgtttaagcatgaggactgattttatggtatgcttaaacacgcgagtaaacagactgagccgggggcggcttagttgagatatagtgaatgaggttaaaaatggatacacaggaaaaaattttagcacaaattaaaaagtacaaccggattgtgattcatcgacaccaacgtccggatccggatgcaatcgggtcacaggttgggctagcaaagattttgcaagcatcctttccccacaaacaaatcaaggtcgtgggaaaacagattgatgggttaagttggctagggcaaatggacgacgttgacaacgattttttcgacgacgctttggtaattgtcatcgatacggcgaatgctccccgaatcgatgatcggcggttcgatcaaggagcctatttaatcaaaattgaccaccatcctaatgacgaaccttttggggacttaatgtgggtgaaggaagctgcttccagtagctcggagctagtctatgatttttacaatcagtttaagtcagagctagtattgccccaagatgctgctagtgatctatatgccggaattgtgggtgatacgggacgctttatgtattcagcaacgagcgcccacactcatgaagtggtggctggcttaatgacgaccggttttgacatggtcaaagttaaccaaatcctggacgaaattccggtttcggttgcccatttgtcagcctacctttatgaccatctcacgattagtgaacaaggggcggcccacttagtactaaccaaggaaatcttggaaaaattcgacttgaaagacgccggaacggcgggaattgtgccgttacctggacacattgcgcaagttaaatgctgggcaatctttgttgaacaagatgaccactccttccgggtgcggttacgttcgaagggtccggtcatcaacgaattagctaagcggcaccacggaggcggccacccgctcgccagtggcgcaaaggcggcggatcgtgatgaggttgctcaaatcgttaaagaattagaagaattagtttaaaagtttgtaaagcggtagaaaactcggatatcttcggtgaacgccaaaaatacattttgggtttgtgaactttagtaagaccagaacgtatgccacaaattagtttggcttaattcaaaatcggctgttatgccagattcaggcatgatggccgattttacgttaacgctcaaaattacctgacttaagcgcaccttctgtaaggatgcccgaacgcttaccgctttctgcaataatatagtaaggagctagtatgaacgaatttcaaaagtttaatctaaaaccatttctcatgcaggctttggatcaaattggttttgtgaaaccgactccggtccaagagcgtgtcatcccgctaattgcggagggccaaagcgtagtgggccaatcccaaactggaagcgggaaaacccacgcgtttttgctaccgatttttaatcaaatcgatccggccaaaaacgcgattcaagcggtaatcaccacgcctagtcgggagttagcttaccaaatctacgaagcggctaagcaattggccgctgcttcagaaactccaattgaaattggcaattacgttggcggaactgacaaaaaacggcagactgctaaattagaacaccaccaaccagcaattgtcatcggaactccgggccgggtgcttgatttacttcaagctcgggcacttaacttccggcaagtccaatatctggtaattgacgaagcggatatgactttggacatgggctttttaagcgccgttgaccaaattgcggcaagtatgcccgaaaatctacaaatgttggtcttttctgctacgattccacagcaattaaacgtctttttaaaaaaatacatgaagcacccggcaattgaagaaattccggtggcgactacgattagtcccacgattaaaaatattttgatttctaccaagagtcaggataaaaacaacttgatttaccagttgttgacgatgggggaaccgtacttagccttagtatttactaatacaaaggaacgggcggacgaattaactaactaccttaagtcgcaaggactaccggtggctaaaattcacggtggaattccgcctcgggaacggaaacgaatcatgaaagacatccaccgcttacgttaccaatacgtggtggcgaccgatttagcggcgcggggaattgatatcgaaggggtctcgctagtaattaacgacgatatcccaactgatttagaattcttcattcaccgggtaggtcggactggccgaaatggtttaccagggacggccattacgttatacatgcctaacgaagaagccgaagtggcagaagttgaaaaaatgggggttaagtttattccccaacaattacgtaaccacgaactagtggatacttacgatcggcaacggcggcagactcggcggttaagtcagaaaaaactggaccctaccttggtcgggttagttaaaaagaaaaagaagaaagttaaaccaggttataaacggcgcattaaaaaggcgatctctgaaaaggcaattcgcgaccggcggatggaacagcatcaagcagttcgtgaggctaagaaagctaaaatgcggcaatcgcgttcgaagcgaagataaattgacaatcttaatttggttttctataattagctgtgatatttagaatcattagggatatgtaaccgtgcaacgcttagtgtagagacgttctggctggtgtaaagaacgaagcgccgcggttgtgctacccgattaataatgaatcgtctgctcagcgttaatgagactcaagaggtatacgatctaaacatcgttgcaagtaaagtggtaccgcgtttcggcgtctttattttacgagcaacggtgttttttattttaggaggaaaaaatggaaagaaaatcaagtagcgaaattcgacgcatgtatctagatttcttcaaaagcaagggccacgtggtggaacccagtgcgtcgctaattccaaaggacgaccccactttgttatgggttaactccggagttgccacaatgaaaaaatactttgatggtagcgtagttcccgaagttccccggctaactagttcacaaaagagtatccggactaacgatattgaaaacgttggccacactgcgcgacaccacacgctttttgaaatgttaggaaacttttcggttggcgactactttaaagaagaggccatccactgggcgtgggaacttttaacttctaaagaatggtttgacatggatccggaaaagctttacgtgacggtttacccgaaggatgaggaagcaaagaagatttggttagaaactggcgtagatccaagccatattgtggaagcggaagataacttctgggatattggggaaggtcctagtggtcctgattctgaaatcttctacgatcgcggtgaggagttcaataaccttgccgatgacgacccagaaaactaccctggcggagaaaacgaacgctggctggaaatctggaacatcgtcttttctcaatttaaccataagccggacggaacctacgaaccactcccacataaaaacattgatacggggatgggcttagaacgggtggtttccgtattccaagatgcaccaactaactttgaaacggacctcttcttaccaattattcacgaagtagaaaagctcagtggtaagaaatacggcgttgataaaaatgacgacgtttccttcaaggtgattgctgaccatgcgcgggcaattacgtttgcaattggggacggtgccattccgtctaacgaaggtcgcggatacgtaattcggcgcttactccggcgggcagttatgcatggtaagaagttgaacattaataagacattcttgtatcaaatggtgccagtagtcggcaaaattatggaagactactatcctgaggtacttgcggacaaggattacattgaaaaagtaatcaagtcagaggaagaccgctttaacgaaaccttaacggatggtttggaattattaaattcaatcattgctgacaccaaagcggaccattctaaggtaatctctggtaaggatgctttccggttattcgatacctacggattcccattggaattagcgaaggaatacgcggaagaccaaggaatggaaattgacgaagctggttttgcagacgaaatgcaaaaacaaaaggaacgggctcgttcagcacgttctaacgctaagtcaatgggcgtgcaatccgacctattaacggacttgaagacgccaagtgaatacgttggttacgacaccttgaaagtagacgctgcagtgcttaaagatattatccaagacgatcagctgaccgatacggtaaatccgggggaagctcgcgtactatttgacgtaaccccattctatgcggaaatgggtggtcaagtagctgaccaaggggtaatcgaggacgctgacggcaacgtggtagccgaagttgtggatgtgcaacacgctcctaacggacaaaacttgcacaccatcaaggctaaacgagaaatgcacaccggtgaatcatttaccctcattgtggaccgggctttccatttgaaggtggaaaagaaccataccgcgacccacttgctcgaccaagcgctccgggatgttttaggagaacacacccaccaagccggttccttagttgaaccaggctacttacggtttgactttacccattttggacaggttactgacgaagatttgcaaaaagtcgaagagattattaacgataaaatctacgatgaaattcccgtaaccaccgtcgaaacggacttagaaaccggtaagaaaatgggtgccattgccctgtttgatgacaaatatggtaaaaaggttcgggtagttagcgttggtgattactcaagagaattctgtggtggtacccacgtaaagaacactaatgaaattggtttattcaagattgtctctgaatctggtgtgggagctggagtccggcggatcgaagccgttacttcccaagcggcactagagttcttaaacggtgaagaagcgctcttacaaaaggcagcgggattgctgaagagtgctcaaatgaaggatgttcctgcaaaagttgaacaattacaagcacaagttaaggatttgaaccaaacgattaaccaactcgaagctaagattgctcaagctgaagttgccaacatctacgatcaagtacaagaaattaacggaattcggttaattactgccgaagtgcaggtttccggcatggaccaattgcggcaaatggcggacgattggaaaactaaggaccaatctgacgtattggtcttaggtgctaagattggtgaaaaggctaatttaattgctgccgtaaaggatccgcttgtaaaggaaggcttgaaggctggcgatttaatcaaagcaatcgcaccgaaggttaacggtggcggtggcggccgtccaaacatggcccaagccggtggttctgcgccagaaaaaattaacgaagcgttgcaagctgctagcgaatggctagagacccagggtaaataattttaaatcctactagtagtaaaatttgcaacataactaaaagggtttctcaagaaatgatagttcttgggaaatctttttaatttggttactttaaggattggtaagtcgtaaacctgaagttagtttgtgcggctaatttaaaaagcatttgcaactaccgtttatatgcgtcaaaaaagacacatttgccaaaaaacgcccctaatttggtagttgaatattacacttcagttacgagcggccccttttattgtgattttgcggttaatcaagtaaaattaatcatagtatgtgaagaggggtgctaacagtgggaaaacttgatgaaaccatgttcttcgattttggcgataataagccaaatgacgttcggggaacgttaaaaaccgtatacgatgctcttgaagaaaagggttataacccaattgatcaaatcgtgggatatttgatttctggtgatccagcttacatcccgcggctaaacgatgcgcggaacttaattcgtaagcatcaaagagacgaaattattgaagaattagtaagatactatttagcagatcaagttgctggtggcaagaaggataagaattaatgcggttaatgggaatggacgttggatcacgaaccgtgggaattgcggtaagtgaccagctaggttggacagctcagggagtagaaattattccaattaacgaggacgagggcgaatttggcattagtcgagttaaggagttagtcagccagtacgaggtagccggttttgtaattggcttacctaaaaatatgaataataccgagggcccccgggtggaagctgcgcgtaattatggtaaactactaacggaaacgtttgggttaccaattgattttcaagacgagcgtttgaccactgtggaagcggaacgtatgttgattgaacaagcggatacttcgcgctccaagcgcaagaaagtaattgataaattagcagctagtttgattttagagaactacctcaatggtcacggtaaattaatcgataaattaaagtgagggcacgcaatggataacgaagaacaaaaaattaccctagtagacgaacacggcaacgaagaactatataacgtattgtttacgtttgattcagaggactatggtcgttcgtacgtcctactttatccggctgaagcagaaaatgatgaagaagtggatattcaagcttacgcctttgaacctgatgaaaatcatgatttaggcgaaggtgaattaatcccaattgaatctgatgaagagtgggatatggttgaagaagtcttaaataccttcttaggtgaccaagactaagttttataatccaagtaacggccgcggtttggtgtgcagatacaatgtctgaccaccaaacgggccgtttttgatttgaaatgaaatgagattatgatgaacagtaaaattttagaagttttagaatatgaaaaagtgaaaattgcggttaaacagttcattgcgaccgaaaacggggccaaggagcttcgccaattagttccaatgacggataccgccaaagtacaaaacgcccttaaggaaactctggacgcggttaacatttaccgggtgaaaagtggaattcccattccgcgtttagaagatattgacgaaccattgcaacgtttaaaaattgatgcgactctcaacggtcgcgaaattgcgcaaattggacgagtgttgcgagcaacccgggaagtaattaatttctttgcggatttaccagatacggaagtaacggtagaaaccctgaacggcgtagtagaccagttagaaacgattccagaaattgaagaacggttaaatagttcaatcgaaggaaatggacatttattaaactccgcatcaagtgagttgcggcggattcgggccgcaattacgcgggtggagggtgagattcggcagcgaatggaaaagtttacccggggaagtcaagcaaagtacctaagtgaacccattgtcacgattcgaagcgaacggtacgtaattccggttcgagccgattcccggtcccgttttggcggggtggtacatgaccaaagttcctcggggcaaaccctctatgtggaacccgaagcggtggttgatttaaataatcagcttcggcaagaacaggttgctgaggtacacgaagaacagcgaattttgcaagaactcagtgcgctgattgctccgtatgtggacacgttaaaagataatagcaaggtgcttggtcaccttgacttgcttaacgctaaggcgcaatacgcgcataagttaaaggctacggagccacagatttcaacgaataaccggattaatttgcgacaggcccggcaccccttaatcgatccaaaaaaggtggttcctaacgacatcaggctgggtggggagtactccaccttagtaattaccggaccaaatactggtgggaagaccatcactttaaaaaccgtgggcttgctccaactaatggcccaatcgggaatgtttattccggccaacgagaatagtacggtgcgagtttttgaagagatttttgctgacattggtgatgaacaatccatcgaacagaatttgagtaccttttcgtcacacatggataacaccattcatattttggagcaccttaacgaacgttcgctagcgctctttgacgaattaggcgcaggaaccgatcctaaagaaggagcggccttagcaatcgcgattttagaccgggtgcgacaaaggggcgcggcttcgattaccaccacccattatccagaactgaaaacgtatgggtacgagcgttcaggaacgattaacgccagcatggaatttgacgtagacacgttgcaacccacttataagttattgctgggaatccctggacagagtaacgcttttgaaatttcacgacgtttaggcttagacgaggacatcattactcaagcacgagggttggtagaccaagatagtcaagatttaaataacatgattaaggatttaactacccggcaaaagcgggcccagaagttaaacgagcgggtccaaactttgttgtcacaaactgaagagtataacgataccctggttaagggagtggagcggcttagtcaacaaagggaccgtttgttagaaagtgccaaagaatcagctaaccagatcgttaacgatagccgtagcaaggccgaccagattattaaacggttgcggcgactagaaaaatcggcgggaaacttcaaagaaaacgatttgattgaagctaagagtaagctgaacgccttacaccaagatactaacttgaagcgcaacaaggtgctccgtaaggctaaagaggcacagaagctccacgttaacgacgaagtgattgtgttaacctatggacaacgcggtgagctattacggcaagtggatgctcatcattgggaagtccaaatggggattttgaaaatgaaggtggctaccgacgaattagaaaaggttaaaccagaacggaccactaaaccagctagccacaacgtggttcaccggaccaaatctgctggggtgaaaactagcttggatctccgcggaaaacgctacgaagaggcaattaccgaaactgaccgttatattgacgcggcactgttggctggttacgacgaagtcaccattatccatggcaagggaactggagcgttacgaagcggcattacaaagtatttaaaacaaaatcggcgaattaaaagttttgagtatgccccggctaatgcgggaggtaatggcgctaccatcgtgcatttgcgatgattcttattattcgtaagcaaaataattcaatttttgattgaaaactgctatagttactatatcaacatggttactttttgagaaagaaggttaaaaatatggttgaagcaattacggacgcaaattttgaagaaaaaactggtactggcgtaacgttgaccgatttttgggcgacttggtgtggtccatgtcggatgcagtccccggtagtggaacaattagccgacgaaatgggcgaccaagttaactttacaaagatggatgttgaccaaaatccggaaactgcccggaaatttgggattatgagcatccctacgctaatggtaaagaaggatggcgcggtagttgataccatcgtgggttatcattctaaagaacagttagcaaagattttaaatcaatacctataattaggtgaatgattaaggggctgtgataaaagtctctaaacaaaaaaacggttcatgaggtgaaacttcctcatgaatcgttttttttggttaatgttcgcaaactatccgacttttgtcgcactctctttttagttaaatgggcttattaagacgactggccccgattattaagttaatcagatctactaataattagggtggtttagcaaatgattgtgttgtttttcattttaataaattaacaatgccaacgccagttgcttactagcttcgaacggttaaatccttgaattaatgcgagttaacgtcccttgacgagcattagtaaacgctgatattcaacatactaaatttaaaaaattgccaggaactcttttactttgtgcagaaatgaactacaatataggcgtagaatgtaaacgcttccatcgattgtttagaattgtttgattaaagttaagtttctgttgatgaggaggtaatttttatgagtagccgcgaaaatgcaaatgtattgtggtttgacgaactgcaccgtgaagacgtaaatctggttggtggtaaatcatcatcattaggggaaatgacgtcggcaatggacgttccggtgccgtatggttttgcaactactgcgcgggcgtaccggtactttatggagcagacgggcttaaatgatcaagttaacgagttgctagaaagtattcaggattacgaaaattctgaagaattgcattcagcatgcgagcaaatccggaatttaattgttaacgccaccatgcctgcagatttggcaaaggacattgaacaagcgtacgcggatttggccaaaaaagttgaccaagacgcccccttcgttgcgattcgttcttccgcaacggccgaagatttacctaatgcgtcgtttgctggccagcaagaaacttacttaaatattaagggggctgccgacgttgttaaccgggtccaactttgttattcttcgctctttaccgaccgggcaacctactaccggcataaacagcattttccgcacgaaaaagttgccctttcagcagcggttcaaatgatggtcttctctaaagcttcggggattatgttctcggttaacgtcgctgatggagacgactctaaaattgtgatcgatgcgatttatggtcttggtgagtacgttgttttaggaaaggtaacaccggatcactttgtaattgacaaagaaacgatgaaaattgttgaaaagaacattattaagcaaccaattcagctagtccgagttgccgatgggggaacggtggaaaaaaaggttcccgaagaacttcaggggcaaccagttttgtcagatagccaagtaattgagttggcgggttatgcgaaggcaattgaagagcattacggctgctacatggatatggaatttgctttggatgccaataccgaccgcttatggattgtgcaagcacggcctgaaacagtttggtcccaacggaaggcggcggatcacgcggatgaagaagatgccgacgtggtcaaagaagcagatgctaaggttgcagttcggggccttccagctagcccgggattagcaagtggcgtagtgcacgtcattgacaatcccaaagacattgaccaatttaaacaaggcgaagtcttggtaacggtgatgacctccccagactgggttccagcgatgaagaaggcgaccgcgatcattactaatgacggtgggatgacctgtcatgcagcaattgtttctcgggaaatgcagattccatgtatcgtaggaactaagagtaaaaatctggctgccaccgacgcccttaagacgggagacgtggttacgattgatgctaaaaatggggtggtttaccatggcaaagtcgccagcatgttaaagaaatctgcctccgcacagcaggagggcaaccaaatggtagcggccgagacctttgcaccaaccgctacccgagtaatgatgaaccttggcgatcctgagttagttgaaaagtactctagcttaccggctgacggaattggtttaatgcgtgaagaattcctctggaccacttatattcacgagcatccgctatacctaatcgagcagggccaccccgaaaaagtggttaacatgctcgcagaggggattgctaaagtagcccggacaatggcacctcggccagtagtgctccggttatccgatttcaagtctagcgaataccggaaactaaagggcggcgataaatatgaaccgcacgaacctgcagatttgttggggtggcggggagcttcccggtactacgatccgaaatacattgacgcctttaagcttgaactagcggcaatcaagaaggtccgtaatgaatttgggttgaagaacctgaacgttatgattccatttgtacggacggttggcgaagcgcagaaggtcaccgaaattatgcaaaacgaagggttagtacggagtgcggactttaaggtttacatgatggcagaaattccatccaatattattttagctgaccagtttaaccagttcatagatggatactcaattggttcaaacgacttagcaatgttgattttaggatgtgaccggaataacgacacggttgcgcgactctttgacgagcggaatttagcagttaaacgtgcaatccatcacctgattgaggctgcccataaggatggtaagacggtttcaatttgtgggcaagcaccatctgaattcccagagttcaccaacttcttaattcaaagcggaatcgattatgtttcagttaaccccgatatggttaaagaaattaagcgaaacgtggcccactttgaacaacggattatgttggataaagcaaccggtcggggaattcaagatcctaccgattacgattggtagaaaggcgggttaactaaataatattaatagacgtacactagaaatcagttttttcccttaacccccaagcgatcattatgccaaaattaggcgtaatggtcattttttagttaatccgcacaacctatccgacttttatctcatacgctggtttgatacttttttagtttcttacggagcgttttttccttttttatccaaaatttagtattatagacaatgtgtaattgatttgtctgggggtaaagaacatggataatcgtccaattggatttatggattccggagtcggcggattaaccgtggtaaaggcggctaaggaactaatgcctaacgaagcagtcgtttttattggggatgaagctcgggtaccgtacgggccacgtcccacgacggaagtaatcaagttttcgcaacaaatggcggatttcttgatcaaacaggatgttaaagcgttggtaattgcgtgcaatacggctacgaacgcggcttttcagattttaagtacaacgttaccaattccagtgattggagttattcaaccgggagcgcaagccgcagtggcaactacacgtaacaatcggataggagtaattgcgactgagggaaccattaaatcacaagcgtattcaacagcgttagcagctttagcaccacaaatagaggttttcccggttgcttgccaatcatttgtggaattggcggaacataaccagttgacgacacccgaagctttgcaggtgattgatcaacaacttgtcggattaaagaaccaagggattgatacattggtcctaggatgcacccattttccactcttagcgaagggaattcaaacagcggtaggcgaccaggttaaactagtcgatccaggtgtagcagcggttcagcaattaaaggacgtccttgaacgacaaggtcttctacgagaagccactagtacacctgatgaacagtattttgctacggcaaatattgcaagttttcgaactattgctcaaaacttcctcgctccggatatacaagtaaatttagcaaaaattgattaggagattaaaatgagtaatcaaattttaatagcgaccaaaaatgaaggtaaattaaaagaatttaaacagatttttactgcgaagggaattgaagttctgtcgttaaaggacgttgatgaagatgttgacgttcaagaaaatggtttaacatttgaagaaaatgcgcgtcttaaggcagatagctatgctaaaactattggaattccggtcctcgcagatgattctgggttagaaatcgatgcacttaacggccgccccggaattttctcggcacggtatgctggggaccataacgatgctgctaataacgccaaagtgcttactgaattgggtggggttcctgacgaaaagcggaccgcaaccttccacaccaccgtggtggttcggaaaccggatggcaccgaattagtggctaacgggaacctccgtggtcggattctgagcgttccacgcggggacaacggttttggctacgacccgcttttttacgttgaagaaaagcaaaagacgttggctcaaatgacccgggaagaaaaaaatcaaattagtcaccgggcgttagccatccaagatttattaactaagtttgataaattctggtaatttaaaaagcaatctctgagggcttccttaaagattgctttttttggtattaaatatcaacgtatattttactgttgaaatttggtgatgaagaagtacttagttttctgaaggaaaatttccgttcacataatcaatgaaaaagtagcgttagttttccacttcaatttgagcttcccgtagaattttcaaggtccggtcaagaatcattgtttgcatcgctgcttgatagccgggggccaccttcgtggagatttggactccgaggtaaccatgacttttttcggcaaccggagcttggataacgattcccgccttcagtttggtggtgtggtgtttagctttgggtagttgatcttgtagcaagtccttggcttcatcaatcctaaacggatctttgatccgcaagaaaatggtaatattctggttttcttgcgaatggttagaaatggttgtaatgctccggttcggcaaataatgcaaggtgccgtctaaggctcgcagttcaatggtccgtaacccgatggagaccaccgttccatcaatgctttggatggttacgctgtcgcctacccgtaattggccctcaatcaagatggtcaagccgttaattacgtcagaaaccagcccttgagttcctaaaacaattgccacactaaggattccagctccagcaaccagtgtaccaaccgggacccccaggttggaaagaatcgtgtaaacgtagaaaaacattacggaatatttgaaaatgtttcttactactacgaaaatggtctgagaacgagcagattgcttttcaggggcttgatagggaccgaaacttttgttaattaagtgtttaccaatccggttaatcacccaaaaaataatactgatgagaattatttgtaaaaaatgtttaagaaaattagcgccaatttgactccaatcaatccgcgataattctctttggagcggctgaaaagcagcgccgataagtaaggtttggggcatgttaaaaatcctttctggttcggttaagtaagtttattttaccagagattaagggtgttttcattgcacatcatgggccacaatgctattctggagacataaactaacgggaggggattattgcatgacaggaggcggaattgcagccatcatcgcggcgatcgcgttgttgattttggtattgtttatcggcttagtgctggtgaatgcttcaaagaccttggcagaaataaatcgtagtttagcaatcattactagagatgtggatttgatttcacatgaagcagaaggcattatggctaatgcaaacgagttgctggaagacgttaacggtaaggtcgcaacgattgacccacttttccaagcggttgcggatttgagcgagagtacttcggacctaaaccaagctacccggcgacttgctgggaaagtcaaccataccgcaaaaactaaaaaaacgggaaaggttgccacagctatgaacgttggcaaaggcgcggttaatttatacaaaaatcggcaaaaaaacaagcaggaggttaaataaatgtcaaaaagtagtttcttattaggtgtaatcgtaggtggagcagcggctacagcagcagcaattaaattaacggacactactccggcagaactaaaggaagccgctatgaaaaaagttgatggcttcatggaagctaacgactttgatatggcgagccttaaagaacaggcagcagcttcggtagacgaacttaagcaacggggaatggacttagctaaccgtgctaacgaaaagttcaatggtgatgatgaaattgctgaagaagaggacgtaatcctcgacaaaatggcaacggcaccttatgaaaagccaactgaggttttcatgccccataaactagaagattaattgtttacgtagcatagtagtaaaaaagtgggaactagaaattatgaaacagatttctagttcccacttttagtctaagctgggtaaatattcaaattttataggtattttagttctttagaagtatgggtaaatggttcacagccatccttggtaatgtgaacacagtcttcaattcgaactccggcaaagccggggatataaattcctggttcgatggagaagcacatgccttcttcaaggactaaatcatttccttccataattgaaggaaattcatgctcgcccatgcccattccatggcctaaacggtgaataaagtattcgccgtagccagctttatcaataatgtcacgagctactttatccaaactagcagctgtaattcctggcttagcgtagtcttgcgccgttaattgcgcttcaagacataccttgtaaatgtcagcctgtttatcgcttagttgtcctaaggcaaccgtccgcgaagcgtcactgatgtaaccatcatgtacggttccaaggtcgaaaagaattaattcgttattttcaatcttgttcatggcagttgctccatgaggttcggcagcgtgcgcacccgcctggataagggtgtcgaaactcatttccattacgccgcgttttttaagggcgtattctagttcagcagccacttcagcttcagttttacccgcagcaacggcatcaaaaccaacttggaaagcaaagtcagcttcagcaccggcagcctttagcttttcaatttcatccgcagttttcaccattcgtaatttttcaaaaacgggggtgagatttgcttcaaatttagcatttggaaactcagaacgtaaaacttcgtaccgatctacggtgagattgtcttcttcaatgctccagtggaccgggttggcgttacgttcccgaatatagtttgcaattaaatggaagggttgttcatggtcgaggtagccataaacggggtacttccagccggtgtctttaattgcttcaacttccaaagcgggagcaaataagaatggatcttggtcagggaaaacaaataacgcgagaacccgttcaatcggatcactcccaaaacctgtcaaatacttgatactttcaaaattactgatgtaagcaacgtccaatcggtgatcagcaacccacttttggactttttctagttgtgacatttgatcgcttctttctttacttaaggtacttcgattatatcacacaaaaaatttgggctacagacgaaaaaaagcttgcaagaaggtacaaaatttgataacgtattcatggcgttgaaaacagtatgaaaacaaatcaaatcaatatggagaggaaattatcatgtcaaaacaaactattacaatttacgacgttgctcgtgaagccggcgtttccatggcaaccgtttctcgggtagttaacggaaaccctaacgttaagcccgacacccgtaagaaggttaacgaagtaatcgaacgcttagattaccatcctaatgcggttgcgcgcggattagcaagtaaaaaatcaaccactatcggggttatcttacctgacatcaccgaaatgttctttgctgcattagcacgggggattgacgatattgcttcaatgtacaagtacaatatcattttggaaaattctgatgaagatgtcgataagaaagtggaagtacttgaaaacttgcttgcaaagcaagttgacggtgttatttacatggggaacgcaatcgacgatcggttacgggaagcgttgaagtcagcacggactcccgtggtttttgcgggttccgttgatgacaagcatgcgttaccgtccgttagcatcgacaacgaagcggccgtttacgaatcagttcgaaaactaattgaaaataaaaacaagaaggttgcttttgtttctggaccactttcacaaccggtaaacggaaagttccggatcgaaggatacaagcgtgctttagctgaatcaaacattgactttgatgaaagcctcgtatttgaaactactaacacttacgaagacggaattaagttagcttcgcaaattgcttcaagcgatatcacggctgctttcgttgctaacgaccgtttagcagtgggacttttaaatgggttacaagaccttaacgtaaaagtacctgaagagtttgaaatcatgaccagcaacaatactaacttaactaagatggtgcgcccacaaattagttcaattggccacccaatgtacgacactggggcggtagcaatgcggctattgactaagttaatgaacaaagaagaagttgaagaacggaacattactttgccatttgacatggtgttcagacaatcaactaaataagcttaaaacgagcgggtgtagaaagtcggggagtttgggaaagttaacggaaatttagcgttacgctaggttcgggttaagcagaacaaaccagctttgacccctaagtaaagcaaatcaaaatgcttttcaagaatttttaatccttgaaaagcattttttattttaattaaaccaaaaaaggtgaagattgtttttcattacgaaaataacaatcttcacctttttaatattatatggactatttatgtataagtcttttataagaaaatccctttgtataacgctacggcacagattcccgctaaaataggggcaattactggaattggtgcgtagttccattgggaagaacccttatgtttaattggtaaaatagcgtggactaaccgtggacctaaatcccgtgcggggtttaaagctggaccagttgcaccaccaagtgaagcaaccaaagttcctacaaggaaaccgagggcgataaataccgagctcatgttttccttgaaatatggggcatgcgtaaaggcagttgcaccgaagaagaggatgaacgaaccaacaaactcgttaacaaagccgttccataagctatcacttgcatcaatggtaccaaaagttcctaaaattgattctgggtcagtggtttgatcgtaatgtggtaagtaagcccagtaaacaactagttgaccaataatcgcacccagcatttgagcaattataaatgggataacttgtgaccagctaaacattccggagacggctaacccaattgtaaatgcggggttgatttgggctcctgacacggttccaaacattaatgccggaaccatgactccacaaccgtaaccaacggcgattacaagccagtcactaccgtttcccttagttcctttaagttccacgttggcaaccgaaccatttcctaaaatgactaaaatagctgtacccaagaattcagcagctaatttagcaaaaaaactatattccatcatctaactcccttaaaaagtattttaatgagacacactgtttaaaagtatatcttatctaaaaggggatatgcaataccaattttgcaagctttcggaggagttttcaaaaataaaaataaattacatctgctttcattgaagaaaaaacaggcgaaatgataaactaagaagtggatgaagctgttaaccaatgcaaagcgttgaaaacgcacgtttaattatgattgagaaggggaagtggttaaaattcaagaaaccaggatgagcaggcaaagtcatttagcagaaaagaaagttgatcaaacggaggtgcccgttcgaccgccacgccttgtggtagcaagggtgttaatgattttatttgggttattcttctttggcgcggtttcggctaaacagaccgtgtttaatgcaaattacgtacagcagcaaattgaaaagtctagtgctgccgaagtaattaatcaacagttggatacccagttacagcaagcggggattaaccaaagcaacctaattccagatgatctagttaacgacgagttaaaaacgatggttcagcaattttacgatgggcagcaagtgcacattgacgaaaatatcattactaacgcaatcaaccaaagcacccaagctacgggggctttccaacaaacggttaacgcaatggtagttagcaaagtagtggccgtttttaatagtcagctagatacccagaaactttcccgatacgccggccaggtgcaaaaattatcgcggattgaccaaaccgtaatttgggttagtggcgtggggctagttttgacattggcatatgcgttgctacgtaaacgactgctcagtaccatcagttctaccttgctagtagtcggcggatttgtagccatcatttgcggaattggatatgtaagcaacgtattgagtaatttaccgattcagtacccagtggttaagcaaatcgtgcagactgctggacaagatttattggtacgagaatttacgatcgcgctagggctattcttggtaggagttgttttagcagtatttggtaagggatttactacgattcgcaagggattgaagcgacggtaggagagaaaaacgaggccagagttggcaagcttgcgagcattaattaaaaatcgactattatgcctgaagtaggcataatagtcgatttttgtttagtcggatttattgctattcggcgagcgtgtcggcacaatttaactcaacggcaacgccatttttctgtaaagtctgcacgtgcatttccccccacgaacataactggtctaacagagtggacaaagtctgtccataatcgctaagggaatactctaccttgggaggaattacgttgtaagttttccggttgacgatgtggtcacgttctagttcgcgtaattcttgagtgagcattttttggctgatgccagaaatttgccgacgcaattctaaattctcattttctaattgtttaattctattttgttcaggagtaaatggtgattaggttttagatttattcttagaattcttttttggcatatttggtttacgtcctttttctatagacaataacccattcgacccattttttacgatatattttttcccattgttgaatttgtaatataccaacatatccaaattcagcagctacttcagtgtatgaagcacgatttctgattttccatttcgttaacttaaccttaaaatcaccattaacttgtggcggattaaataacacatctgaaccataggtttcgtaagcgctaaccagcattttgaataacgttagtgtaataccgtacctagcagctatcttcgatttagattccgttccagtaaaatattcgattagtgctctaagttttgtttctttagaaattttagtcataaaaataccccagaagttaattttttactttaacttctggggtacacctcagtttacagggcctttttacgtggtttatttttactatttatggtggttaataaagcttaatcccacatatcatttactactacggtttgttcacggtcaggaccgattgaaaaggcactaacttgtacgccagtaatttcttcgatcttcttaagataatttttcgcgttggcaggtaattcatcgtaagactgcatttgggttaaatcttcttgccaacctggcaaagtttcgtaaattggggttaagttttcgagttccttttcagaagctgggtaataattaattactccgtgatcggtttggtaaccggtacaaattttcacttcgtcgaagccggacaagacatcgagacagttgacgactaagtcagtcaagccgttgacgtcggcaacgtacttcatcaaaaccccgtcaaaccaaccaatccgccgcggacggtgggtaacggtaccgtattcgtgagcaacttcgcgaatgcgatcaccaatttcgttaatttgttcggttgggaaaggaccttcaccaactcgagaaacgtatgccttacatacgccaatgacgtgcttgattttagttaccccaattccagagccggtagcagcaccaccagccgtcggatttgaggaggtaacgaatgggtaggtaccatggtcaatatcaagcatggttccttgggcgccttcaaaaagaacccgtttttgttcgtgcaatttagtgttgattaagtaactggtatcggtgatgtaatcttttaggatttgtccgtattcagcgtattgctttgtaagttcatccacgcttggtaattgttcccaaagatcgtcatctaaaacccgttgcttttgagctaggttgaaggcaatcttttcttttaatccttcagcgtcaagcaagtcgacggcccggatcccgatccgttgcatcttatccatgtatgccggaccaatgcccttattggtagtaccaattttttcgccgtttttagagcgatcacgttcttgttgttgatcttgcaagatgtggtaagggaaaatgatgtgtgcccggtcagaaattcttaagtggtcggtgtttacgccggcttgatttaattctttaatttcgtctaatagggtgtgtgggttaaccacggttccgttgtcaataatgcaaattgaattaggtgccaaaattccggatgggattagtcgcaaggcaagcttttgatcgttaacgaccaaggaatgacctgcgttatctccaccagagtaacgaacggtaacatcagcgttttgtcccaaaaaatcaatgatcttaccctttccttcgtcgccccactggctgccgattactactgtagctgtcatcttcattcctccatttttatcaatacacaacttcctgataataacataaaatagggtaaatttaaatgagtcgacccgaattattggaagggttaagcatttgatagttcgcgtttattaattagggagagtttgataaaataggttagtaaataatttttttaggacgaggggtaatctaaatgattgatcgttatacacgacctgaaatgcaaaaaatatggaaccggcaagcgcagtttgacagctggctagaagttgaaattgcggtagtcaaagcttggaataaggtcggaaaagttccggatgaagacctagcactaattgagaagaatgcgcgttttgatattgaccgaattgatgaaattgaaagtcagactcaccatgacgtgattgcctttacaagggcggtttccgaatctttaggtgaagaacggaaatggatccattacggtttgaccagtaccgacgtggttgacactgcacaatcgttgcggattaaagcagctaacaaaatcatcgcagctgatttagaaaagctccaagcaactttgaaggaaatggcaatcaagtataaagacctgattacggtagggcggacccacgggattcacgcggaaccaactacggtcggtttgaaattcctacgctggtattccgaaatcaaccgcaatattgaacgcttcaagcaggctcgccaacacattgaagtgggtaaaatcagcggtgcagtaggaacgtttgctaatatcactcctcaaattgaagagtgggtttgcgaaatgttgggaatccggcaccaagaaatttccacccagattttgccacgggatttacacgccgaatacttaagcgtgctagcactgattgcttcccaaattgaagaaatggcaactgaaattcggcatttacaacgtaccgaagttaacgaaatgcgggaaggctttgccaagggtcaaaagggttcttccgcaatgcctcataaacgtaatccgatcggctcagaaaatgtttctggtttaagtcgggtggtgcgtggcgagatggttacggcctttgaaaacatgaatttgtggcacgaacgtgatatttcgcattcttcggcagaacgggtaattttaccggacgcgacttccttggtggactatgtattaaaccggatgaaccggattttaaataacctggtcattaacgaagacgaaattaaaaaggatttggaaatgacccacgggttgattttctcacaacaagtcatgttgaagctcatcgataaaggttggactcgggaagaagcttacgacactgttcaaccaattgccatggaagtttggaatactgggcagcattttatggacttactgcttaaagatagtaaaataaagacgacgttaagtgatgaagaagttaaatcaatttttaactatcgctaccacttgaagaacgttgacgcgatttaccaacgttgtggaattaacgtagaataagcaggtgcaaaaccaggaagcgaggaattaaaatgggggcaaacgaagctttactgattattgattatacaaatgattttgttgctacgaacggagcgttaacgactggcaaggtgggccaagcaattgaaccagccttgattaaagccgctaatcgggaacttcgcgaaggtggttgggtaatgctaccaacggatctacatgttgaaaaggatccctaccatcccgaaaccaaattatttgatgcgcataatttagaaggatcctggggacgggaattgtatggccaattaaaggactggtacgaattgaatcaggataatccgcgggtccggcagtttgctaaaactcgttatagttcctttgcgggcacagatttagacattcgtttacgtgaacgtcacgtagatactttgcgattagcaggggtttgtacggatatttgtgtcttgcatacggcagttgatgcctatgacctgggttaccagttaattattgacccaacgacggtcgcaacgtttaccgaacacggtcaagaatgggcgttgtcccattttaaaaatgcgttaggggcgacgattgaatagctgatttaaaataaaattgagtatctaataaatttagaagtgtagtgctagcttagtggataagtgggcgttgcactttttttatagctaaatgctttttagccccgctagagaagccgtccatttaagcgcttttttatgctagaatggagataaacaataaatcgcggagggcgcagatgagctttactctaaaaatcatgcgaagcattttttcaatccctcctaactaagtttttagggaggattccatatttattgtaaataacttaaaggagattgattaaatggttgaagcaattaatttaaaagcaggaatgacgtttattaaggatggtaagttgattaaagttcttgaaacgaaccaccacaagcctggtaagggaaacacggtaatgcaaatgaagctttatgacgtacgttcgggagctaccgtgcaaactacgatgcggccaaccgaaaaagttgagcaagcaattgtggatactaaggaagcccaatacctataccggcaagacgatacggcgattttcatggacacggagacttatgaacaatacgaactaccaatttcaagtattgaacaagaaatgaaatacttactagaaaatacggaagtgaaaatcaacttctatggtgacgaagtgatcgggattacgcttccaactacggtagaactcaaggttgtggaaacttcaccttccattaagggggcaacggtaaccggttctggtaaaccagccactatggaaaccggtttggtagttaacgttccggattttgtccaagagggcgaaacgttaattattaataccgaaaagggtacttacacaaaacgggcgtaattgtgcagtcttagaatagaataattaatctacttttcgcagttagacgacgttgcgaggaaatgcttgaagctgggaatttttcccagcttttttgtttccgtgggtggaagcggttaacgtagtgggaaagttaaccgcgataaagttgagtgctattttagacttttagggaaacctttacattttcggcaattgggtgtactttataattgttctaaagtagaaatgggggttagttgatgattaagtctaaaattgggtcgatattttttgtattgctctacgtgtatttgttttacttggtggctactaaccaaatgatgcccgcaatgtacgtaatggcgggcggaatgctgttggagtcagtaatatgcttgatacataactttaaaatgggagggaaatcaaaatgattacaaagtatctatatgatgaaaacgcctatgattatcatgacggtgggtaccgcccgttaaaaaaggcgcctggagaagaacacccattgaacgttccggcttttttgaaacctgatcgaatagaaggaaatgaaatttattatacggtaactgctcaagctggagaaacgaagattttgcctggcaagccaacgcacacttggggatacaacggtagtattttaggtccggcaattcagtttgaaactggtaagacctaccacgtcactttaaaaaatgaattagacgaggttactactttccattggcatggattgaatattgtgggaccctacgaagatggggggcctcatgcgccagtctatccgcacggggaacgtaaaattacgtttacggtcgaccaaccggcggctaacatttggttgcatccgcatccatgtccagagacggcgcgccaagtttggaatgggctggcagcaccggtaattattaccgatggacacgaacaaagccttaagcttccacggcgctggggagttaatgattttccagtggtattgcaggatcgtagctatcacgataatcaactagattacaaagccgactacgatgtggacggaatcttgggcgattacgcgttggttaacggcacggtcaatccggcggttaacgttactaagccaattgtccggttacgtttcttgaatggttctaaccggcgagaatggcggcttcactttgcggattatcatcccttcacccagattggtagcgacgggggactgttgccggaagccgttggaatggatcgcattatgctgacctgtgcggaacgggccgacgtattggttaacttctccgattaccaaccgggacaagaggtaattttgcaaactgacgacttcgacctaattaaattcaaaattggcgacattaagaaggaaaatatgctgctaccgtcaccattggcagaaattccagcattgtccgttgacgaaaatactccggtcttcaaaacggtgatgtccgggatggatgatcaagtgcggttggatggcaagttgtttgatatgcaacgaattgacacccgccagcaagttgatcaaacccaaatttgggaagtttccaacactaacgacatggaaggtgggatgattcacccgttccacatccatggctgccaattccaattgattgatcgcaacgggcacgcggttaatcccaatgagcacggttggaaagataccattggagttaaccctaacgaaacggttcggattaaggttaaatttaccaaattaggaatctttatgtaccactgccacattttggaacacgaagataccggaatgatggcccaaattgaaatttttgatccagatcacccaattgaatatcatctaatgccaatgaaccataaaatgtaggaattagggagtgttttacggttaaggtcaacaagttaacgtgcattagcggtcggcaatcaatcggaataacttccagttagaaacttggcggattacggacgcggaagcgatcttggatgagcacgaacttccgttgacaagcatatttcggaagcgtattatattaagcgtctatgaatacgataaatataatatgaaagaaggagttcggaaatgtcaggacattcaaagtggcataatattcaaggccgtaaaaacgcccaagacgcaaaacgtggtaaaattttccaacggatctcccgggagatctacgtggcagttaaagctgggggtccggacccttctgccaaccctcaacttcgcttaatgatggataaagctcgtgcagctaacatgccaaaagataacattaaacgtgctattgacaagggtagtggtactggtggagctaactacgaagaaattacttacgaaggttatggaccagcgggaaccgcaattatcgtttctgctttgactgataataagaaccggacggctgcagctgttcgttctgcattcactcatcatggtggttcactaggagctactggttcagtttcgtacatgttcgaccggaagggctacatcgttattaaacgcgaaggtttggataaagacgaagaccaaatgatggaagatgctatcgaagcaggtgcggatgacgtacaaacttctgatgaagtgttcgaaatctacacggatcctaaagaatttgctgccgttcgtgatgcacttgaagctaagggttatgatttggcaaatgctgaattaaccatgattccggaaacggaaactcaagttcctgctgataaagtaaagcaatacacgggattaatcgacgaattggaaaacaacgacgacgtttcagaagtatacgaagctgctgttttaccagatgacgctgaataataatgaatttcagaaccaaccccattttatgcgggttggtttttttgtgcctttttagtaaaagaaagtttcaatggtggtaggcgggcataaaaccggtgtggtaaaatcattgcatacgtaatgataatgaggtggcaaaatgactaataaagtagttgtgctaggtagtttaaacgtggatcgaattttacagatggatcgggtccccgaacctggcgaaacattagcattaaataatcaagacatggctggtggcggtaaaggagctaaccaggcaattgctgctgctcgctctggtgcgcaaacgagttttattggccgggtcggcgcagacgaaaacggtaagttcatgctgcaacagttggttaatagcggagttactaccgacttggtagcggtagacgaggatgcaggtactggacaagcatttgtgatggtagaaaagagtggcgaaaaccgaattttaatttatggcggtgccaatgcgcaattatccgccacggacgtgaagaaggcccaaacacaaattgctgcagcagatttaatggtcgcccaactagaaactcctgtagaaacgacgcaatttgctttccaaatggctaaagagttgggagttaaaaccattttgaatcccgcaccagcggtggctaagttaccagcagagctactaaaaaatacggatgtgatcaccccgaacgaaacggaagtcgaaattttaactggaattgccgtgactgacgaagcggcaatgttaaaagcagcccaacgcttacacgacctaggcgtggcgaccgtaattatcaccctaggaagtaagggtgtgttctacgatgatggtgcgcaacacggaatcgttccggcatttaaagtccaggcggtggatacaacggcagcgggagatactttcttaggtgctttaagctcggaattaaatcctgatttaagtaatttaaaaaccgccattgagtatggtaacaaggcctcttcgttagcagtccagaagatgggggcgcaaccttcaattccgactcggaaagatattctgaaataaatttctatttcggtaggtaaaaaacatttagttgtaagaaagtcaaagtgggttgtccgttaagtaaagctaattaagcttgcaaatacgatttattaccagaaaaggtgaccaagttaaaggaacctcttaagaatcgaaaaattcttaaggggttcctttttagttttttaaggtagttaaggttagcagttttactcaccgcggtgataacaaatttactaattaaaaaatggtttaaaaaaataaatttgccgacttttcgtatctacatgatgaggaggcgaaatgagtagtggatataacaaaccaattaagtcgaattatgcaagaaagcattgttcatcatgatagtgatttgtttattatgccccgtaacgataaataccagatgctttatcgaaatgtgcagggatatcgcaagtctacgcacatcgaacagcgggaagccgaacaaattatgtcatatattaagtatcgcgcagatatgtcaataagtgaacgacgtcgaccccaaagcggcgccatgacctggttggcagccgatggtcaggtggtgaatttacgaatttcaacggtaggggactttttagaccgcccttcgatggtggttcgctttatttacgagttgaagcagcaacatgaaattttagacccggtcagcctgcaagatattgaagcggcggcgcgtttaagggggatgattgttttttctgggccaactggttcggggaagactacgttaatttacgagattgctaaaaagttaagtggttcaaaactcgtaatgtcgattgaagatccggtagaaattcaagaaaataacttcctgcaattacaggttaacgagaagtccggaatgacctaccaagcattgttaaaaagtggactacgaaaccggccagatatatttattattggcgaaattcgggatagtaaaacagccgaaatcgcggttcaagctgcgctgagtggtcacttagtattaactactttgcattgtaaaagcacggaaggggtttggtaccggttgctagagttgggagtgcaagaagattatttaaaggaggcgctaactgccaccatttaccaacggattattccaattaaaaatggttctatccgaattctagcggaaatgaagtcattccacccgttgttaaaaactaagtcaccaaggtggcagaccaagttagaggagtggaaaaacagtggccaaattaccaacgaagtatatcaggactaccagtacgggtaaaatacctttagcagaccaggcgtttatcttctccacgatggtggatttgttaaaaatgggcatttcgctaagaaaaagcgtagattttattcgtattatgcgaccctcgattgctaaaccgatgcaaaacgtgattgaacagctgcagcgcgggcaatctttttcggccgcctttcagccttacgtaagcacgaacatttattatcaactggcaattgcagatcagcatgggggccttgttaggacgctcaacacgattgcccaaattttcaccagtcaagaacagcaacgaaaaaaactacggtcagtgatccaatatccgttatttttgctattgtttttaggactcatgatggtggggatgcggatttacatcatgccagaattagcagactggaatcggggaactaaaagttgggatagccaattgattaaggcagggtgggtagcggtctttttggttgcggtagcagcgctaggatattatttctggaaattcaaacgttccagcattactaaccaagtcaaccttctttgtcgtttacccatcattgggccgctttaccaaaattattgccactattatttattagcaaacctatcttttctaattgccaacgggatgtctgtgggaagtatttgtaaataccttaaccagttagattcaaaatcgttgttgcaccaaattgggcgaaaggttgaacacagcattgcgaacggccggcaggtggatcaaattattcaaaaggctgtttatctgccaaccgaactaagtttggtaatccaaaaaggaagtcaaaaagatgccttagcaacggaaatttacgcgttgtcaatgatgaagtataaaaacttaattagtcggattgaacgtttgattttagtagttcaaccaattttatttggcattattgggatagtaattgtaattatgtactggaacctattgatgccaatgtataactcaataaaggaagtgtcgtaatgaaaaacagaattaagaaagcgtttacattaatcgaaatgacggtcgtgttgtttatcatttcattattaatcctaattattttaccaaacgtaactagtcaaaaacataatgctcgcaacatccagggcgatgcacttaccgaagttgttcaaactcaagtggacttgtatgaaaatgaatacaatcatttaccggaaagcttagatgatttaaaggaaaaaggatacttatcggataagcaaatggaccaagttaatcaggacgggattaaagtagatagtagcggtcatgttagccgtagttgacgtccggaaagcgggatttacccttttagaaagcattgtggtattgttaatcacttgtagcacaattggaatggggctgattaattttcggggagcccatagtgaacagcaggagaaaatattttttaaacgtttcgaaatgggttggcaggaaatggaacggttggcaatgtatgaaggttgccagggctcggtaatttttattaaagacgatcacagcgtgatgtttcattggcagcacggacgggagcgacactctaaatatttagatttacctcctaacttagagccgtataccgaccggaccattcggattggtcgagatgggattgttacccccacgacgatggttttacaggagaatggtcaaaacaaataccgcttagcagcacagttaggatggggtgtttatgaaattacccgggtgtaaaaagactggcacgttgctttatgaaggaatcgtgggactatttattctgggaagctttttagcagttatgatgaacacttggcatagttggcaggttagtattagggaaaaccgaatcgagcttaatcaagaacgggaagttttaaatgaactcaggcaaaaattataaatacggatttacgttggctgaagcaattttagcattattaattatggtactgatggttaacttaacaatcatggcagtcaaagcaactaagcataaagctgaagctgattttgaagacaaaattaccgaggttgttcaagatttagaatcaaagcggcacgattttcgtttgaaagaagttcgccctaatcgcttgatcttgtattcagaagcgcaaaagaagcgttacgagctggagtactattcgcaaaaaaatatgctgcgttatactcccgggcatatgccgttaatgccgggggtgcgtgcggtttctttcaaacgggtcggtaatttagttcaaattaaaatgaaggtttatggaggcaactatagtgcgtacgcgtttattccaccagccgaaaaagaaagctagcgcgatgattaccgctttgtttgtattaacgtttatggcgggaattaatctgtttttgaatgaccaagcacgacaaacaattttgcgattaaaaaatgaacaagcgaccacccaagttaaaatcttggccaaccagtttttattacgttaccgagaaaaagaaattaaaaagttgactaataaaaaactgggtacggtagaattaaatcaggatcaaaacttgacgataaaactcaagaaaggtaatactgtaaaggttagatttaacgaaagtggatattagtgaggaaggatcgcaaatggatacagaaaaaattgaaaaaatataccgtgtttttaaggaatcaaccgaactattacaaaaaaatttggacgtggattttttagacgcgttcattgaaacgggggataacttaattacgggagaaatccaagttgaagacggtaaaccagatcaagtaacggtacaaaaattaaagcaagtttacgcagattttaactggcaggaatatgaacctgaagagcttcgcaaggccatccaattggtgatgatccaagcaaaccgggtcgaacgcatccaagctaatcaccaattcactccggaagcaattggaatgctttttaactacatcattgagaatttgccgttatcccaagatcaagtatcaatattcgacccggcagttggcacggggaacttgctatcaaccattttgaattattttcaagatcaccaagttaaattcaacgggacgggaatcgataatgacgatactatgcttgcgattgcaagtatgtcctttattttcgagcatttaaaagtggatctctaccatcaagacagcatcgataatttgttggttaaaaatgctgatattgtagtttcagatttgccggttggatattacccaattgatgagcgaacggttggttttgagacgcgtagctcggagggacattcctttgtgcaccatttattaattgagcaatcaatgaaggcagtacggccgggcggctttggagtttatttagttccaagtaacctttttcaaacggaagaggccaaaaagctactagcatttttccatgacaagatttatttacaggcgattttaaacttgccaagtaagatgtttaaagacgctaaagcacaaaaatcgattttaattctgcaaaaggtgggtcagaatgctaaacaggctgatcaagttttgttaggtgaattcccagactttaaggagcaaaaggaaatggtggcgttcctcaaggatttcaaaaaatgggcgcaaaaaagtttaaaataattgtttgaaccgcttaattatttttaagcacagttaccccccgataatttcgatgccgcaggctggagacctctgatagaggtttccagttttttgcgtagagggaaattgtacaaagttcttatagccgcggtacaattaaaaatgattcttagttagaatgaaaaaatcaagggaaagtaatgaagaggatgataatttgaatttttttacggcagatacccatttttttcataaagagctactaaaagaccatgactttgcgccacgtgattttactaatattaatgcgatgcacgaagcaataattaaaaattggaatcaacgggtgacggatcaggacgtggtttatcatttaggcgacattgcgttaaattttgtgcgcccagaaaaaaaggcgcatgaagaggtgtacgaactattaaaacggcttaacgggcgactagttttaattaaggggaatcatgattcgcggagtttatttaaatatttatctaaacataattacttagtgaatggtaagccgaaatttgaatttcattcggtaggaacaattattaaaatgaatcaccggcagttaattatgagccactacccaattatgctagggattgtccagcaagtgattaatttgcatgggcacatccatcattatagcgtgaatattaaggaaaatatcaatgtgggggtcgacactcctgaaaaggattatttagattaccaaattccgtttggcgcccccttttctgaaagtgatattgaacaaatgattgacggaaaaagaattgactttaaaaaacggcgttaagctgtaggctatggaaaagttacggtaattaaagtaagatattgacctgtacgttccttttaatttaggatggtgctatacaataagcggggaatagtgatgaataaaaaaacaaatgaagagttggcggaaatgcgacgtccggtggttaaccgggtcgttcaagtcaatacagacgaggttctaatcaacgatcacgaatatcgtttagaaaaaaattatcgcgatgcgtttgatgaagaattgatggccgaacgctttgtcgggttgctgagtcggtacgactttattgttggggatatcggttcgggacaactacggctgaagggcttttttgcagatgaagaaaaggtgcctaacgaattaaaaatcagtcgtttcgaagactacctttttgaaatttgtagttttgggtgtccatactttatattacgtaatatgcaagttaatgagcgttcaaagcgacgctggattaaagaatggcaccgcgcagaaactaaacataaagcaaaacggccggtttcgaagaaggctaaatcacgcaagccagtcgcaaaacgacgtaacgaagtggtgggtaccggtaaaaagaaacgacaaaaaacttttaaaataagggagaaaaagaagtaatgattgaaaattatggtggatatatgattgatttagacggaacgatgtaccggggaaaagagaagattccggcagctaagcggttcgtcgaacggttacaggaaaagcagattccgtttttgttcgtaactaacaacacgactaaaactccagaagacgtagcaaaaaatttgacggaaaaccatgatattaaagtgaaaccggaaaatgtttacacggctgctttggctactgcagattatttggatggaattgctgacaaagatcatcgcaaagtctacattatcggtgaaatcgggttgaaacgtgcaattttagcgaaggggtttgaaatggaagaagaccaacccgactacgtggttgccgggttggattacgatgttacatatcataaatttgaggtagcaaccttagcagtaaaaaaaggtgctaaatttattggcaccaacgcggacaccaatttgcctaatgaacggggattagtaccgggtgcgggctctgtaattgctttgctagagcgttcaacgcagcaaaaggccttttatatcggaaagccagaaaccattattatggaaaaggcattaaaggtaatggggttgccaaaggatcaggtagttatggtgggagacaattacatgactgacatttccgctggaatcaattttggcatggatactttattggtgtatacgggggtttcaacgcctgaattggtggcaaagcaggcggttaaacctacgcacgaaattaatagttttgatgaatggcaataaaaatgcgcaaactaatggcagctttattgacaatttgggttggaattagtggtgcgatttttcttacaatcaattcgccctggttgtttcattggtcattaacggcgcgaactgttcacacaacgggtttaactactgcgcaggtcatcaaaaattatcaccaactattagcgtacttagaattgccctgggtgaaacgtcttaacttggcggatttccctttttctaagggagggttaattcatatggcggcggtaaaaaatctgtttttattaaattccattacgttggtattggcaatcggcggactactattaatttggcaccgaatttttagagaaaaacaggagtggcaaatgttgcgtttctttcagattgccattgtggtaactccgttaatcatttttttcttggcagtggattttaaccgttattttattatttttcatcaagtcttttttagggataattattggatttttgatccaaaaacggatccgattatcaacgtattaacggatcggttttttgcgcttagttttgccttaataggaattctttttgaaatgtacatgatcattttttatcgaataataaaaaaacaggtcctaacgtagacctccgtttaatgagcggggttacgttagttgacctgtttttttgattttgacttgatgaacgaaattattgcaggaattagggaaacgacgataatgccaattaccactaatgaaaaatgctcttttacaaatgggatgttgccaaagaagtaaccagcaccacagcaaacggctacccaagcaaaattccccacgatgttatagcggatgaatgatcggtaaggcatgttagctccagcagcgacaaaaggagcgaaagttctaatgatgggcatgaaccgtgctagggtgatggaaatgttaccatgcttctcgaaaaactgctgagcttcgtccattttttcgtcactgataaacttaccaaagaagggatgcctgcgcagtgccattccgacgtgctttcctaaaaagaagtttagggagtctcccaataaggctgcaagagaaaataaaatgatgaacgcccaaacgtttagcccgtattcaggtttagcggaaagagcagtagctgcaaataaaagggaatcacctggtagaaacgggagaattacggcaccagtttcaataaagataatggcaaatagaattaagtaagaatagttaccgaagttatttacaatagttaccaagtgttcgtcaatgtgaagaacaaagtcaattagagtttgcaaagaatcattccttatctaaaaatttaggtatcatatattgaggatttaactttcaccgtctagaaagccttgttttaatcccgcttttctcgaatccgcagtctatattatcatacagttagagaaggaactttgcttttttaaaagattaccttaaaattaaacttttagaggggagcagagcaatatgtataaactaggagaaatacttgaagtaaaaatcgttggcatccgggattacggtctttttattcaggataaaaagggacgtaaggggttgatacatgtttcagagtgtgacaatcagtatattagaaatatgcaccacgcttttgatattggagaaaaagttcaagcggtggtaatggaagatgatggcaatcgacgctttgcgctgtcaattcgtgctttaaaggaaaccaagggtaacttaagtaagtaccctaggccaattaatttttttgttaatcataagcatttttggacaaaaagccactatgatgcaggttttaagccgttagcagagcacttggaggggtggaaagcggaaaaattaaaataatttagaaaaatgggttgacgtacccgtataaaacttggtactatatttgagcggcgttaaggaagacgtcgttcatcgcaagactaggagtaatgaaagctatccaataaaaggaatccacagttcgttaagctttaaacagtggtgaataactaaaactaggtttctgttctcgggtcaattacgattaactaaatcatttttaacaggtggttagagctcattgattagcaaaaaaattaatcatcactaagccgctttttttacgataatttttagctatttgttgcgaataaacgttttacagcaagaataaatatggtatactattctagtaaaagttgccactatagctcagctaggtagagcacttccatggtaaggaaggggtcgtcggttcaaacccgactagtggcttaatagttatcttcttcatgaggacttacccgatcatcgggtaagcccttttttacgtcgggaattaaaaattgtggtccgtcatcaagattccttttgcttgtctttatgagatttagtataattttaaaaatgtgtcaaatttcgacaagggggaaattgatggatggattcgaaatatcgggttgaaagtatcaaaaagcagtatcggcatatgacctattgggatatgtttgcgacttggattggggctaacgccaataacgggacctggtttattggagggattattgcggcgtgtggtttctggggcggaatcaaggcgctcttgattgcctccagtatttcgtacatattcttgatgatggttggctatatgggaactaaaacaggtgtttccacgatggcactttcgcgggcttcgtttgggatccgggggagcatcattccatccttagtaaatttaacccagtttgtgggttggacggcggtgaacaccttcattgcggctacttccgtatcttatatcttacatagtttttggggctggcccgtttacggacaacctggtggtaatttaggtttaattgtcgggattgtggtaatgagcatcctccatttacttagcatcgttgctgggcaacgttcaattcaaattatcgaacggattgggattattttagtgattatctttgtgatttgggaatcggtggtggtatttcacgacgtctcctttagtcaaattgcccactggcaggtaccacatcacttaaaaatggatcaagggaccgcgatggatacgctagcagcgtttaaccttgcgtgggttacggccggtgcggactttacccggttcactaaaaaggtaaataccgccactaccgctccgttcctgggcgctaatttaggagtctttgggtttgcgtttattggattaagcgccacgattagtatcgcggttagttcgggcgtttacgaccctaacaactcggatcctagtacgattgctaaccggctgggactaggcgtaattgccatgatcgtcattatgctaactagtatgacggcaaacgcggttaatattcaggctgcgggctcggccttgaataacatgtttagcaaattatctttaaaacaatcgttactgattactaccataattgctacggtggtcacgtttatccccgttttctacggtagtttcttaaccacctttacagccttcctggactacgttggcatggttcttggcccgattatcagcatcatggtggtggactacttcttgatcgccaaacaacgttacgcggcgaaagatttaggtgatccccacggaccatattggtaccataagggaattcactggacggcctttggactgtggatttttggtgtattaatttatagcgctttacaaagggtaagttttgttcaaaaatatacgggagcaacctttttggtgatgattttgattggttgtctatattggggaattatgcaactagaaaaggggaagcacaatgctgattaaaggtgtgtatattgaaaacgcaaaggaaccaaaggatgtccgggttgaaggaggagtttttcaagaaattgcgcctaatttaacctctcatgaaagtgaggaagtgattgaggcacagggcaaactgttgttgccgccgtttgttgattcacacgttcatttagacgcaacgctgacggcgggtgatcccgaatggaacgagtcgggcactttgtttgatggaattcggatttgggcggaacgcaaaaagagccttacaaaaaaggacgttaaaacccgggccctgcaaacgttgaaacggcaagcgcaacatggaattcaatacgtacgaagccacgtcgacactaccgatcctaactttacggctttagaagccctactagaagttaaggacgaagtaaaggactttatggaattgcagttagttgcctttccacaagaaggaatttggtcgtttcctaacggtaagcagttactgaaacaagcggccgcgatgggagttgacgtaattggcggcattccgcattttgaatttaaccgggactatggagttgcttctttgaagtacatcgttgaactggcggaaaagtacgataaattagtggacgtccactgtgatgaaattgacgatccaaattcacgacacttggaagtgttggcaaccttggcttacaaaagcggcctgaaaaatcgggtcacggctagccacactaccgcaatggggtcgtacaacgacgcctacgtctacaagttgatgcgattcttggaaatgtcggaaattaacatggtttccaacccgttaatcaacattcacctaggtgggcgattcgatacgtatccgaagcggcgcggattaacccgggtgaaggagttgctagaacaccacgtcaacgtctcgtttggtgaagacgatgtgaaggatccgtggtacccaatgggcgatggcaacatgttggattcagttcacatgggcattcacgcggcacagctgatggggtattcacaaattatggattcttacaatctgactactaataacggagccaagacgcttaacgttgaggatcattacggaatcgcggtcggcaaaccagccaactgtttgatttttaacgcggataatttttatgacgagttaaacgagcgtaaagaattgctttactccattcaccaaggtaaagtgattgtccaaactcaaccagcacaaattaaaattaatttctaaaactaattggcaactcaacgggcatttcgttagggttgccaatttttttgtgctataatttaattcaaatacaaacaaggaagttgagcgcatgaaagatttagttcagaccttcgccgaacagaaaagcgacctgtggcaagccctactccaacatttggggatttcactggttgcgttggtactggcgattgtaattgcaatgcctttagcaatttgggcgacgcgacaccgcaaaattgcggaaattttgttgcagataacgggagttttgcaaacgattccgtccttagccttattgggattgctaattccattagtggggattggcagcgtgccagccatcattgccttggtagtgtacgccctgttaccaatatttcaaaatacatacgtggggatcaccgagattgacccatcgttagaagaggcggcggacgcttttggaatgcgaccgttacaaaagctattccgcgtggaattacccaccgccatgccggtaattatttcaggaattcggacgggactggttttaatcatcggaacggcgacgttggccgcgttaattggcgctggagggctcggaaatttcatccttttaggaattaaccgtaacgaccctgcgttaattttggtgggggccatcagctccgctctattagcaattgggttgagcgcgttattaaacgttttacaacggtggtcggtgaaaaaaatcaccatcagtttggcaattctcgtggtggcggttaccggcgccacggttgctaaaatattaactccgccgaccgaaacgattacgattgcgggaaaattaggttcggagccggacattttaatcaatatgtacaaggatttaattgaagaggaagctccccatactaaagtgaccttaaagcaaaactttggggaaacgagcttcttatttaacgcgttgaaggctgacaaaatcgatatttacccggaatttagcggtaccgtattagaaactttggtgaaggacgccccttcccagcgcctaagtgcggcacaaacttacgcaaccggtcgtaaattgttagctcagcaatatcaaatggactatttgaaaccgatgcgttatcaaaacacttacgctctagtggtgaaaaaagattttgccaaacaacatcatctagaaaacatttcggatttaagccggattgaaaaccagctacacggggggatgacgctcgagttcattaaccgcaaggacgggcggaaaggaattcaaaaagcgtacggcttagagtttccggtcaagtcgatgcaggcttcgttgcgctattcggcaattaaaaacgggcaaattaacgttgccgacgcctactccacggatagtcagattcgacaactcgggttgcaagttctcaaggatgaccaacacgttttcacaccgtaccaaggcgcgccgttaatgaagaagagctttgctaaaaaacatccgcaagtggtccgcgcgttaaaccgcttagcaggcaaaattacggaagcagaaatgcaagagatgaattatcaattgaacgtccaaaaacgttccgcccaacaggtggcccacgactatttggtcagcaagggtttgttgaaaggagccgaacgtaaatgagtaagacaatgattgaatttcggcacgtgaaaaagatttttggtggtcgaacagtaattgatgacctaaattttacggttaaggagggcgaaattttcgtcctggtcggaacttctggtagcgggaaaacgaccactttaaaaatgatcaaccagttgtttgtgcaaaccgccggtgacattttgtttaacgggcagagaataaaggattatgatttgcgtaatttacgtttggagattgggtacgtgctccaacagattgccctatttccaacgatgaccgtggagcaaaacatcagtttgattccagaaatgaagcgggtcgataaagaagaggttaaacggcgggtcacccagctgttagaagatgttgatttagatccagagcgctaccgcaaacggtgcccgcgggaactttcgggaggcgagcaacaacgaatcggaattcttcgtgcattggctgcgcaaccaccggtggtattgtttgacgaacctttcagcgcgttagaccctttggtgcgggcgcagttacaggacttagttttaaagttgcaccagaaatttaagaacacgatcgtttttgtcacccacgatatggacgaagccctgaaattaggggaccgcattggggtgatgaaggacggaaagttgttgcaagtagccaccccgaaagaaattgcccaacatcccgccaacgaatttgtggaaaatttcttttcagccaccgtgggtaagaacctataccaaaccgaagtggaaaaggtggtgcgcacgggttttggggtgtcggcgccgtccacgacagaaaaattacctgtcatcccaagaacggccagtttagacgaggtgttccaacagttagctgagcacccaattttacaggtggtggatgaacatgggcagactaccggctgggtggaccggccgtccttgtttaagtatttgagtgagacagtccattaatttcattaatttagtcaatgagggggagcattatggaaaaatttgacgtagttattattggtgcaggacctgcgggcttagggttagcgtataatttaaaacaagctggtcaaaccgtggccgtagtggaagaaaatcgctggggcgggacttgccccaaccgcgggtgtgatccgaaaaaagttttaatggcggcagtggaagctaaattacgtagccgccacctcgttgggaagggcttagaaaacgaaccggaaattgactggccttccctaatgcgttttaaggaaacgttcacggaaccagtttcttcaagcagccgccagggattagtcgacgccgggatcacggttttagacgggcacgctgaatttgtagatcaacacacgctaaaagtaggcgaacagcgggtggaaagcagccaattcgtaatcgccactggccaacgtccgggacgcctaagcaaaattgaaaatgaagcattgatgcaaactagtacagactttttggcaatgccagaactacctaagcgaattgccttagtaggaggcggctacattgcttttgaattggcagccatcgcgaacgcagccggtgcggaagtacacgtgattcatcacaacgatcggcccctgaagcagtttccagcagaaagcgttaagcaatttatggaacaactgactaaacaaggggttcaattccacttaaacattgacgttaccgcgatcgaaaaaagcgcggaggggatgaccttgcgggatgaccagcaatttagtttgccagtggaccaggttttcgttactgccggccgagtgcctaacatggataccctgaaccttgaacaggctggggtagagaccgcgaaaaatggtatcatagtagatgaccatttgaaaactacggcaagcaacatctatgcaatgggcgacgtggtggctaaagcgcaaccgaaattaactccggtggcaggctttgaagcacaatatttggcgcaattgttgacccaccaaagttcggcagccattgcgtatccagtgattccaacggtcgtgtatggggttccccaattagcgaaggccggagtggaagttgcaactgcacaaaaagattcgcaacgctatgaagttaaggacttggatttaactaattggtttacctatcggcggatccaagatccagacgcgcgggcgacggtcgtggttgaccgccagtctcagcaagtagtgggcgtggttaccatgagtagtgaggcggaacacgtgattaacgaccttacgtggctgatcaaccatggcggtagtcttagcgagttacaacggcaaattttcgcgtaccccactgaagctagtgacttagagtacttgcggtagttaaaatttaagaaaaggatcgtgatttaatggagttcgtgggcgtcctcgttttaatcttaggattgacactgttagcgggccactttgcacaacggattggcattcctgccgtagttggccaattactggtgggaattgttttaggaccgggagttttaggggtaattcacagtaacgaaatcaccgcagtgttttccgaaatcggagtcattattctgatgtttttagccgggttagaaagcgacctgaagatgctgaagcgttatattaaaccggcgctggtcgttgccgtcatgggggtaattttgccaattgcgctggtaggcggcgcgagtttgatcttcggggttagcccaatggaagccctctttattggggtgattttttcggctacttcggtaagtatttcagtagaggtgttgaaggaataccaaaccctaaataccaaagagggagcgacgattttgggcgcagcagtggctgatgacatccttggcgtattgttattaggggtaatgattgccttaactagttcgagcggcggctcacggactagtttgggcggcgcgcttttttaccaagtgctatttttcattgccgtgtacgtaattgggaaatggctggtgccgatgctaatgcgagcagcggaccatctttacattaccgctgcccgaccagtaatgtcgatcattatttgtctgggactggcttggttagcggacgtagctggtttgagcggcgccatcggggcgttttttgcgggcgttgccgtttcgttgactgacgaaaatgacgagttaaatgaaagcattgagccaattggctacgccgtttttattccagtattcttcgttagcgtcgggctttcgatgtcgtttgcgggattgcagtcggtaatcgggttgattgtcaccctgacggtcttagcgaccttgaccaagttactaggttgcggcgccggtgcgtacctgtccggctttgacgtaaccagtagcggagtgattggtgccgggatgatttcccggggcgaaatggcgctgattaccttgcaaattgggtatggagaacacttaatgagtgaaacatactattccgcaattgtgttggtaatcgtgctggtaacgttgattgcaccgttcattttaaaagatgcaatcaagtacaataagcgcgcgatggcacggtaaatataattgagagtggaacaaaaagacgagcattaactgaaaaaagaccgttataccttaatttggcataacggtctttttgattaggcggaacaaactgacttctggcgcacgttttgattttattgaagtcaaaacccccagtgatttttcgtttttctcagctttgtctttttaatttttagagctttcccgaagatttccacactctttttatgctaaagccttcttccttcatttgggtgatgatttcgctgaccttaccaatacttatcaaattgaggtggtgcatggctctggaagcaatcgtgtacagggtgccccgccacaatttttcgggataattctgttctgaaacgtcgtaggcaattaccgaatcaaattccaaccccttcgccaagtaaatgggtaatacaacgattcccttaggcaacgagcggtcaccgtcggttagcaggctaggttttaagtcatgcaaccattctgcaacttgagtactttcctgcatgtttttggtcaggatggcgacggtcccgtaatcttgcaattcggcttggcaaatttgtttcactgcggtaatggcctcggaaggggtatccgtaaccgtaatttcgggtaacttaccgtgccgactaaagggttgaatcttatcaccgtcgggtagtagagccgccgcaaatttagtgatttccgcggtggatcggtagctgcggttaagggtgatcaggttggcccggtgaacggcaaacgcgtccttaagtttttcaagtaacacggccggttcggtaacgtccttgaacaaagcttgttcactatcgcccaacaacgtaaacttggccttcggaaaggcgtgcttgaggtacattaactgggcaaccgaatagtcctgcatttcatcgatgaagacgtactgaaacttgcgattgatgccgcttccggtgatcaagtcccgcaacatcattaacggagcggcatcttctaaacgcacgtggtgcaattcaatgtcgttattgaaggtggtggctgccgcggcgccatcaatttccgaagatgggagttgccttaagaaatccgcgtactgggcgtaaatatcaataaagtagttattaaaaatggcatcgtcgataatttcaaaagccttagtaactaagtgacggccaatgaaataattttcttcatcaaaggagttaaagtggcgacgtcccacaatttcgtggtatttttcgtcactaatttggtcgagctgggtttgcacccagtccgcagaaacctcttgatcaatccgggcctttaataacttaactagttggtttttagttcgtaaaatccgttcgcggttgctcatggatgcagggaaactcgcaaaaatttcgcgaatctgctcctttttaaagaaaggcgctccttgataattgatgtcggtgaatttaatattttccggggtgagttgggcttcatattgctgaattaactcaatgtaccgttggctttccttaaatgaaataatccgctgttcttccgcggtttggctaacctgattttcgaaacggtcaaacaggctttggacgttgagtccttccaaacgccggttaagaaattcggccagggtaagctggcgcatgttacgttcccctaagctaggcaacacgtcggagatgtaacgactgtacagtttgttaggcgagaacagaacaatttcgtctgcgtcaagggaagcccggctatgataaagcaaaaaggcaatgcgttgcaggatcgcggaagtcttcccgctaccggctaccccttgaacaacgagcaggtcgctgtgaacgtcccgaatgatgtcgttttgttccttttgaatggtggccacgatgttgcgcatgtattcgtcattttgctcaccgagcgcctgctgcaatagttcgtcaccgaccgtttcgttagtatcgaacatgtgggtgatttcgccgtggctgatggtaaactgtcgtttcttagttaattcggtttccatggggcccgccggagtttcgtatttgacctttccgagggttccgttgtaataaatactggaaatgggcgcccgccagtcgtaaattaaaaagtcgccgtcttggtcggcaaaggaggccacgccgatgtatagtgattccggcgcggtttcgtcagggtcttgaatgtcaatgcgtccaaagtaaggcgaatcctgtaattcagttaaggagttgatttgtcgttttaaaatggcttcgttttccactgcccgggcaaccaaacctttttgctgctggatttccgcttccgtttcaatccggtcgtcggcttcaatcaagttgaccttagcgttttgcgaatagttcttttctaccttgctagtttcgtgatgggccttttcgtacaggtcttccgtccgctttttctgggcgtcaatctggtcaactacgaaatcgacgcgttgttgttcttgctgttgctcgtccacctgaattacctccgtccttttagtgcttgaaccattttaggggccatttcctggaaagtcaaactaaaggatattaagggagatttttttgacaaggtcagtgaaattcctatagaatggaagagaagtagtaagccaagcacagagagggaggattgctgaaaaatcccacggcaagcgaaatggattggttacgttacgtagggcgaaatcccttatctttcaagtgagcggtgactttatagaaaagtcacaatttaggtggtaccgcgagatttcgtcctattattcaaattttgaatgataggtttttttatttattaaattaagttattggaggaaaagaaatgacagccaaaaaagttattttgaccggtgaccggccaaccggaaagttacatatcggtcactatgtgggttcgctaaaaaatcgggttcaacttcaaaacacgggggattacgataccttcatcatgatcgctgatatgcaggcgctcacggacaacgcccgagatcctgaaaagattcgcaatagccttatccaagtggctctcgattatctggcggtagggatcgatccagcgaaatcgaccatttttgttcaatcacaaattccagcgcttagtgagcttacccaacactacatgaacttggttagtgtttcgcgtttggaacgcaacccgaccgttaaaactgaaattaaacaaaaggcgtttggccaaagtattccagctggtttcttgacttacccagttagtcaagcggccgacattactgcgtttaaggcggatacggtgccggttggggatgaccaagaaccaatgttggaacaaactcgcgaaattgtgcggagttttaacaatatctatggtaaaaacgttcttgtggaaccagaaggctacttcccaccaaagggaatgggccggatccctggtttagatggaaatgctaagatgtctaagtcgttgaacaacgccatttatttggcagacgacgcggacacgattcaaaagaaagtaatgtcaatgtacaccgatccacaacacattcgcgtagaggatcctggacacattgaaggtaatacggtctttacctacctcgacatttttgatccagataaggaaaaagttcaagaattgaaggatcattaccaaactggtgggttaggcgacgttaagattaagcgctatttaaacgaagttcttcaagcggaattgaaaccaatccgggaacgccgggaaagttacgcggctgaccttgcgggagtttaccggattcttgaagagggaagccaaaaggcaaatgcaattgcgaaccaaaccttgagcgaggtgcgggaagcaattgggttgaattattttaaaaaatagagtgcggaagaactcgggaatttccgaggattaacagaatcaaggccttaatcacggtttgggtgattgaggccttgatttagttaaccggaagaaattgagttctggagcacgtttcgacattactaaaggcaatccattgaaaaggggactcggttttttaagtccggaagagcttccttttttcttttcttaacgaaaggccggatctaattttaaatagtacttaaggaacgctaattgataaggttttactagttttgccaactctttaacgcgctcaaccattgggaatggtaaaataaaaaatgaatatatcaattaaaatgaggatcccataatgaaaaatttagtaattgtcgatttagggtcgaattcggtacggatggccattaactcgattacggatgaaggcacgttccgggaaatcaggcgggttaaagaagactcccgaatttctgaaggtatgggacgcgaacgcttgcttcggccgcaagcaatcaaccggacgattgaagcacttcaccgttttaaagaaatttatgaagagtacccgagaattgaagttcgcgggataactacggcggcggtacggatggcccgtaaccaaaaagactttttaaaacgcgttcaacgcgaaacgggaataaaattagaggttttatcgggagatgacgaagcctactacgactatctgggggtcattaattcactagaggtcaaggactgtttggtactggataccggaggggccagttgtgagttaattgacgtgcataatggtaaggcgcggaacatgatcagcatcccaattggggcggtgtcgctttcagaacggttccacttaagcaacgtgattcgtggggataatttattttccgccgaaatgtttgttaacaagcagctccgtgacgtttggtggattatggacgcgtttaataaaccggtagttttactagggggcacgaaccggacgttagctcggatcaaccgctgtcggcaaaaaattgcccgggtgaacaacattcacggctatcggctaaaaacggaagtaattaaccgcaccttccgttctttgattacccgtaatctggaaaatcgcaaaaaaattgctggtttggaaacggctcgggccgacattatcgtgggcggggtgttaccattggtgatgctacttcagatgattgactcggaccgggtaatcttttcggaaagtggcgtacgggaaggcattatttcagaatacattaaccaacacgtaaagggagttaatttatgattgaaggataccatcggttaagccggcaagcccagttggaattattgtcagaagtgactggcgtaggggtggctacgttagcaaaactgccaattgacgctgtacggcagcaacaaatcgaaaattatttaactgatttccgagtaccggaaggaattgcggtgaatttcaaagttaacggacgtgaacacgtggttccaatggtcaccgaggaaccttccgtaattgcggcagccagcaacggagccaagttagtttgccaagctggcggatttcaagcacatagtaagcggctgatgcgcggccaattattgatgaatacgaaaacgagcatcgaagttagccaatgggtggtcgaccaccaaaagcacctgttagaagtggccaatgctgcccacccttcgatgcaaaaacgtggaggcggcgcgttaaaaatcatgccacgcccgctgtctgctacccagctatccgtggatttgctagtcgatacaaaagaagcaatgggggctaacaccattaacaccatgcttgaagctttgaaaacggaatttgagatggaagggattgccgtagagatggcaattttatctaacctggctgaccaggcgctgactacggttacttgtacgattcctgaaacggttatcgattctgcggtagcccaaaagattgctgatgcaagtgaatttgcccagattgatccgtaccgggcagctacccataacaagggaattatgaacggaattgacgccgtggtgatggctaccgggaacgactggcgggctattgaaagtggtgcccacgcatttgcagctcgtgatgggcagtaccggggactaagcacctggcaaattgttgatcaccagttacaaggccaactagtagtgccattgccggttgctacggtcggcgggtcgattggaattaatgaacaagctcaactaaaccttgaattgcttcaagttgatagtgctaaccaacttgcagaagtgattggggcagttggactcgcccagaatttagcggcgctcaaagccatcgtgaccgaaggaattcagcacggacacatgcggttacaggcaaaatcattgttattagaacacggattgcccgcaactaaattaaacgaggcggtgccccggttattaaaagagccgcggattgatgccgcccacgcccaaaaaattattgaacaaatgagaaagaaggatcttgatgagtaacgtagaggttaatgaccaagtaaaatcactgttagaagccgttaacgcaaccttcccgggggaggtccgcttaagttttggtgaccaacaggccggattcgttcggcacgaccaagcccaacaattccacgagccgggaaaaatgttaattaaggtagacgatattaccgcgcctaactacacggcttctcacgaattaattcacttattgatggtactaaaaggatttccgcaactgtactttggtttaacgactggggaaaaggaaaccgaccagcaattaatgtttttaattacggagctttacgacgtaattgcccacgaagtggtggttgatgagcaacggcgtcacgacttgattgatgaacaagtggaagctgaattcttgaagggaattcaagacgcggtggaacccgaaacggatggcaaagtagatggctttagcgccattcgtttaatcatgatgatggacgcaattaatttttatggcgaccatcttagcgattacgaagcacagttaaccgcggattatccaaccacgtttgcaacggcccaaaaaatgatggcggaactaaaccaacgcagcatcactagcccgtttgacttacaccgaaaagtagttaaggcgtttacgatggtggaccaacagcttcaagaatgggacttgccagaacttcatgccctagagtttgttacgttgggcagcgtgtttagcgaacggcaattacggttatccgttaaacaattattccaaatttaccattcggaattgcacgaaaaagctcaggacacccgggcctttgtaggattaggaattggcgaccaacaaaacgccttcgtagttcctacgccaaaggataagcctagtgacgaatatttccgggaactgtacgcaaaaaacgttaaggacttctttgacgaaattaagatgccgtacaccactcgctaatttaatcattaactcaaaactctggttgcggtcgttgacgttaaccagagtttttaagtggggagccgttgttaaacgtcacgcagtgcaacgcaagaatagcggcataataaaaacccagaaaaacttttaagtttttctgggtttacttcaagttaataaattatgatttttcgggaactactaccatagccaccaggtagatgatgaggcccgggaagaatccggaaaagacggtgattgcagtgtaaataatccgtaataggttggcatccacgttatatgtttccgcaaagccaccaattacgccgctgattacccgatcggtggatgatttatacagccgtttattcatgtgctcacctcatttcgtttcttacattatataacatttaggtaagaaaaacgcgaaagatgaatcccgatagctaggcagaaaattaaatggtagaattattaggtactgattccatgtgtaaaattggagacattaaaaatgagtgaaaaaggttggagaattacggcaaacattgctggaatactttcgttagtggcggtattcttgttcatgtttcgcatgttagtaggtaagattgatttttggaccatcctgtttttttcgttaattgtggtcggagcggtcgcgtacgcattgatccatatgattttaaaaattcggcggttaaccccaagcaaagaatcggttaccgagcaggtttcggagaccagggaattcgtgggactctttatgagcattttagtagtttttgcttgtgcgatcggctttagtttttttagcaaaacggcagctggtgaagcagcgggaacgattttgtttggggcaactttaatcacgatcgttgccaagatttatgacatctggcgattaacgaacgcaaaaacacaagggcggcaaatggttggacacgatccaatttggcccctgtcacaagctgaaaaaattgggtgcggtcttttcttaattggtattttggggatgtggctgtgggccccattattagcgattagttacgccggactattaatttttttgatcaagccaattcgtcaccgcgtggaaggccggtggctggacgtgcttttaatgacaattaatttagtgatggtgcttttatcgacacttttggtggtttttaaataaatattaataaaactgaaatcaaactaaccgtgaacttttggatttgaatttcagttttttatttagaaaggaattcaaatgatagaaattggtttaagtacgtggacggaccatccggcgttgtcaacggaaggaaaggacaaagccacgttaacggaatacgcgggtcactttccattggtggaagtggacagctccttttacgcgaccccttccttatccaacgtggttaactggcagcatcaggttccagaacagtttcggttcatttttaaagctaaccaagcgatgacgcttcatgatggggtagttgacgaagactacttaactaccgagcggcggatggtgttcaccgacttttataaggtcatgcaacccttagtgaaaactaatcaattagctgcggtactctttcagtttccaccgtcgtttcgttgcgaactgaaaaatattcgttacttattcgaggttcgtcaaatgatggggaaactgccaattgccgtggaattccgtaacgctagttggtttactgatgcggtgactgaagataccttatcttatttacaacgcttaaaaatgattaacgtgacggttgatgaaccctttgatgggaaccaagggatgccgtttgttttacaagtcaccagcgcaaaacaggcgtttttccggctacacgggcgcaatgccagcggctggttcagtagcggcaagaactggcggcgcgaacggaccaactaccggtactcgtctgcagaactgaaagagttggcagaatccatcaaggcggtcgcggaatcagtccaagacgtcatggtgatttttaacaacaatgggaatcacgatgcggtagccaacgctaaagaattgcaagaactcctaggaattcattttacgggactgggcccgatgcaattagacttattttagcccgggaagcgcccgtttttccgcgtgctatatggtacaataacagtaattatctttagactagaattgaggaaccatgatggcagaaaataatacttattacattacaacaccgatttattatccatccggcaaattgcacattggtaattcctataccacgattgcttgcgatgcggaagcccgttttcaacggttacaaggcaaggacgtcttctttttaaccggtactgacgaacacggcttgaagattgaacaaaaggcggaagctctacacaccaccccccaagcttatgtagacgacatggccaaagggattaaagagctttggaaattactcgaaatttccaacgacaagttcattcggactaccgatgaagctcacgaaaagtccgttcaatacatcttccagaagctgcttgaccaaggcgacatttacctcggcgagtacgaaggctggtactccgtttctgacgaagagtacttcactgaatcccaattagctgaggtttaccgtgacgaaaacggcaaggtgattggtggtaaagcaccttctggtaacgaagttgaattagttaaggaagaatcgtactttttcaagatgagtaagtacgcggactggctgctagattattacgaaaaacatcccgacttcattcaaccagctagccggatgcacgaaatgatcaacaacttcattaaaccaggtcttgaagatttagcggtgacccggacgagcttcaagtggggagttcccgttaaaaatgatcctaaacacgtaatttacgtttggatcgacgcactttctaactatatcaccgcgttaggttacggtagtgacgatgacagcttgtttaaacgttactggccggctaacgtacacatggttggtaaggaaatcgtacgtttccacactatttactggccaatcatgttgcacgcgttgggattagaaatgccaaaacaaatttacggccacggttggttattgatgaaggatgacaagatgtccaagtcaaagggaaacgtaatttatcccgaaaccatcgtggaaaaatacgggttagacgcacttcgctattatctattgaaggcaatgccttacagtaacgacggaaacttcacgccagaagactttgtttctaagattaattttgatttggcaaacgacctggggaacttattgaaccggaccgttgccatgattaacaagtacgaaggcggcgtaattcctacgttccaaagcggggttaacgaagtcgatgcggaccttgaaaaggttgctgcagaaaccattaaaaattatcaagaattaatggaaagcatgcactttagtgacgcattagctgaagtttggaagttagtttctcgttcaaacaaatacattgatgaaactacgccatggattctagcgcgtaacgatgatgaagaatcaaaacaaaaattagctagcgtaatgaaccaccttgcggaaagcttacggattatcgcaattttgattcaaccggtgatgacgcaatcaccagcgaagattttcggccaactaggtttggatccggcaacgatggaacttcaaggtttacactttggcgaaattccagccggcactaaggtggtagaaaagggaacgccaattttccctcggttagatattgaaaaagaagcggcatttttgaagggtcaaatgactcaatcagacaaaaagaagggacgggcagcaatggcagaagcaaatcaagcaaaggctacggaagaaaacgtaaacgaagctaaaaaagaaattcgcattgaagcattcgataaggttgaactacgggtagcagaaattctggaagcgggccacgtagagggcgctgacaggttattgaagttcaaattagatgcgggcgatgaagaaccacgccaaattttgtccggaattgcacaatggtatccaaacccagaagaattagtgggtaagaaggtagtaatcgttgccaatttgaagccaagaaagatgcgcggcgaaattagtcaaggaatgattttgtcgacggaacgcgatggccaagtaaacgtggtaatgctggacgaaaaacacgaaaatggagatgtgttgggataaaactagagggaggagtaacccgggtagctcttgaggattaacggaattatttaattaatcgcgggttaagcgattgattagataatttggttaaccggagagagctgggttacggagccgatttcggcaaagcagccacttccgctgtgtttatcctaagaatctggaattgataagtgaaatgcgaagaagctgggaaaaacgttgttcaccccagcttttttgctattaagtaacggggcgttaagcccgatttgataagttggggaggcaatcaagatgaaaatttttgattcacatactcatttaaatgacgaagctttttggggaaacgagcaaacgtacctggatcacgcgcgcaagttaggggttaaagccacggcccaagtcgggtccaacaccgttttaaaccaacgggctctggaattagccgaaaaatacccccacacctacgcgattgtgggatggcatccggaagacacaaaagatttccatgaatccgagcgagcaacgttattggaacagttgaaaaatcctaaggtagtggctttaggagagattggattagactatcattgggatacgtcgccccaaaaaacacaacggcgggtttttgcggaacaaattcaaatcgcccaagaacgtaatttaccgattgccattcataaccgggatgcgatggaagatacctacgaaattttaaagaatgccagcacacacccaatcaagggcgtgatgcacagtttcaatggggacgttgcttggatggaaaaatttttggaactcggattaaacatctcgtttagcggagtggcgagttttaagaagactaaggaagtgcacgaagccgttcgccaagtaccgttggatcggatcatggtggaaaccgacgcaccatacttagctccggagcctttacgcggcaagcaaaacgaaccggcctacgcactatacgtcctagaagctttggcccgccatcgggacatggatccagacgaattagcaaaggcaacttttgaaaatacaagtaaactttatgggattgaaaatgaagaaaattaaagaagtaattgtagttgaaggaaaagacgataccaaacgaattaatttagcggtcaatgcggatactttggaaacccggggttcggcgctgtctgaggaaacgattgaacaaattcagcagttgcaagaaacacggggagtaattgtgtttaccgaccctgatttttcaggtgaaaaaattcgtaaaactatcgcggccgaagtacctaacgttaaacatgctttcttaaagcgtagtgatgccgttcccgaccacaagggtagtctaggggtcgaacatgctagtccagaagcaattcggcatgcattagagcatctttatacggaagatgacgaagcgttgccccaaatttctcaggacgacttaatggaaactggattaattgtgggaaaagaggctaaacaacgccgaattaagttaggcgaaatattaggaattggctacgtaaacgcaaagcaactaccaaaaaggttgcaattatttcaggtagctaaaagtgattttgaacaagcagttcaacaaatttacggaggaaagtatgaagaatcagattgagattgggaatcccacgcgaacccgggcgattttagaaaaatatggcctatccgctaaaaaaagcttaggtcaaaactttttaaccgatcccaacgtgttggttaacattgtggacgcagccgaaattaacgatggcgacgacgtgattgaagtagggccgggaattgggagccttacggagcaaattgctaaacgggcccaccaagttttagcctttgaaattgaccaaaatttaattccggttctagatgaaacgctggctccgtacgataacattacgattatcaacgaagacgtacttaaagttaacgttaacgaagtggtcgtggaacatttcgacggacagcatccgattaagctagtggctaatttgccgtattacatcaccactcctatcttaaaatcgttcatggtaagctccttgccaatcgcgaaaatggtggtgatgatgcaaaaagaagttgccgaccggcttaccgcgcaacctggtgacaaggaatacggttcgttatccgtcgtggtgcagtaccgcatgcaaactcaggtagagttcacggttcctgcccgggtgtttgtcccacaaccaaaagtggattctgcgattgttagtttaacgccgcgcaaagattggccagtttatcctgcagacgatcgcgacttcttcaaaacggtgcacggatgctttatgcaccggcgaaagaatttgtggaataacatgcagggattatacggcaaggcaccggaaactaaagaaaaaattcagtccgtattagacgagttggaaattgacccgcatattcggccagaacggttaacggtggttgatttcatcaacttgcacaatcaaatccaaactgtcggactaaagcgtaaataaaccgttttaattgaaataaagcacaaaaaaactaaatgtaaagcgttgatattcaattgttggtgtggtaaaattgcatcttttgtgaaactatgatagaatgtttcacatgggaaggtgaagttaatgccaatcacactagctacaataaaagataaactcgataatcgtatcggggaagaattattggtagtcgctcaggctggccgcaaaaaagtaactaaacggcgtggacgattgcacatgacatacccagccgttttcgtagttgatttggatcaagacgagaactccttcgaacgtgtgtcgtacagttacacagacattttaactagaaacatcaaactaaactttgacgatgaaactgatggtgaagaagccgccgaagacatcgaggatgaagaagacgaagcagaatttgatgcagagtaacttctagctaataaaacttggagagccgtggtggaggggctaattaaagctaaaacacgcggttcttaagcatggaaacgggctgttaaccaaaacagcagaggccgcaaagtcattaatgactttgcgtttttttgtgtaatagatattagaggataaattacttcccggaactttggggcgcggcttttccaagttacacttggtggtttggtttgtaactattttaattatcttgttttgctaataattagggtaaagtttcactttgtgttaaacacccttttttattttgtttaattttctagtataatcagtattaaaagtaaacaaagcgggtggagtaaatggaaatcaccgagaaagctcctgctaaattgaacctttttttagacacgccattcaatcatcccgatggtttaccagaatggaacatgattatgacgtcggttgatttagcggactatgtcaagattgaaagtattccaggacgcacgggaattaaggtgcggacgaatactggttttttacctaacgatagtcggaacttagcgtatcaagcagcccgagttttgcaagaaaagtaccaaatccgcgcgcgagtgaacattgagattcgaaaacacattccggtagcggccggtttaggtggcggttcttcagacgcagcagcggtattgcgcggtttaaaccagctgtgggatttaaaattaaataacgaagaattggctaaaattgggttgaccatcgattcggacgttccgttttgcgtctatgggcatacggcacacgttttgggaaagggtgaaaaggtgattcccttaaaaaagctgcccccaatgtgggtggtaattgccaagcccaagcttagcgtttctacgccccatattattagtaaaattgaacaccaaactttacaacactcaaatattaaattaatgctcgacgcgattgaacacgaggattatgatagtatttgtcgttatatggggaacgttttagaacaagtaaccggaaaagaacatccggaagtactaaaaattaaggataaaattaaacaattcggggcggacgcagcgcaaatgagcggtaccggcccgaccgtgtttggaatttgttccaagtcgacccgggctaaacatattgttaacagtttaaagggtttttgtcatgaagtatatttagtgagaattttgtgagggatagaaatggctaatcatgaagcaacaaaaaagaaaattgtcgacgggttatttgagttgttaaaggataatgagttagccagcatatcagttagtaacatttgccagactgcgtcagtttcgcggatgtcgtactaccgaagttttaaatctaaggaccaaatcattgactataaaattgaccagatatttacggaattttttaactacttaatgactcgtcctaatcacgatattagtgccttcttggaggcttactttgcggtttgtcggaaaaatgcttattacattggaattttaatcgacgctgatttaaacgaccgtttgtataataaattgcatttttacctaaccgatctaattgaaaaaggaattttcaaattacggacggacatccccgtaatgtgggttaattttgcggctggcggcttaagtcaaatggttgtgcaatgggtgaaggatggactcgtgcagacaaaccaagaaatggtaatggttgcccatcgcttcttaaggtagcatatttacatagttgccaaactggttaaagaacgtggcaacggtataatggacggaaaccattctgctatgggggattggtagcgctctcgtaggaaatttactataatagaagcataaattatgggagtgatggacatgctcgagtataaaaagatcttagtaccaattgatggctctgctaatagtgaatgggcgctgaaaaaagcaatttcggtggctcagcggaaccatggacatttagacgtggttaccgttattcagtcctcacgttttatggatatttatgggcatatgggtactaacatgaattacgtcgaagtatccctcctccgagctaaggaatatgtcgataacattaaggaacaaattcagcaaaagtaccactttactgatattgacgtatacgtggaagccggcgatccgaaaaccgtggtggccactaatttgccagagaagttaggaaccgacctgattatgatggggtcgaccggcctgaacgctttgcaacgaacgctgctcggttcggtagctgattacgtagttcgcattgcgccagttgacgttttgctggttcgcaccaaaatggataatttcacgattgctaaggaagtataacaggaggaattgagatgagtagtacgcgggaattgaacccaagaagattcagtcaaattttagtcggggtagacgattccccggacgcgcaattagcttttcggtttgcaatgaaccgggctaaacaagatgatgctgaattggacttggtaacggttattgaagaaaacgacattaatatttaccaggcgttggataaaaactttattacccaaaaacgggctgagctagaaaaacatttgcaagactaccgaaaaattgcgcttgaatttggaatcaagaaggtccaaacttacattgccgaaggggaagccggcgaaacaatcgtcaaaaacgtaattccgcgagttaacccggatttattagtgattggctcctcttctaagacgggcatggccaaatattttggttcgcaagcgtcatacatggctaaacacgcgccgatttcagtactggtggtccgttaaaccattattttcaataaggtgctagcgatttctgaaaccgatgaataactaattaaatgagtaaataaagggtctgcgagatgttctctgcagactctttttgcattttaagaacaatggggacgtggttttcacgaagtttcaagaaaaaacttacgaaaaaattttctttctgctatagtaatctagttgcgtcattagatagggtacttaaaacaactagagtacgtgaaagaaagagggcttgattttaaatgaaacaaaatgaaaacaatggcatgatgcaagctagagttccagttgctcatcccatgatagtcatggcaagcatgatgattggcgcgttcgtaggaatgtttagcgaaacttcgttaaacattgctttaccacaattaatgagccatttaaacgtcgccgctggtacgattcagtggttagtaacgggttacatgttggtaatcggaatcgtattaccattttcgagtttaatttcgaaatggtttactacccgtcagattattatatttgggttgttagcgtttatcgtcggagcggtagtttctgcgttatcaacagcctttccaatgttattggctgggcgcatgattcaaggaatcgcgaccggtttgatcttgccaatgatgtttaccgtggcaatgcaagttttcccgccttacaaactgggtgcggcaatgggaatgtgtgccttggtaattatgtttgcaccagcaattggtccaacgttgaccggtttaattttagctaagttatcttggaattggattttctgggcgtttgtgccattcttagtaattgcgctattatttgcgatttttggtttgaagaacgtcggtgaattgacgaagcctaaggtggacgtcctttccctactagaatcaattattggtttttctggaatcgtaatgggtgtcagctttgccagtgaacaaggttgggcttccccgctagtgctgggttcgttgattgttggaatcgtcgtcttagcactttacgttaagcggcaacttgcccttgctgaaccagtccttaacttaaagatttttgccattccggcttttcgaaccggcgcggtcttagtaatgttagattttggcattattttgtcagcaatgtacttgttgccaatgtacattcaacgggggttgttactaccagttgccttaacagggattatcatgttgcctggtggtattattaacgcgttggtatctgcagttgctggccggctttatgataaggtgggcgcaaagactccggtacgcttaggcttaatcattgccttgatgggtgcattgatgctagtattcaccaccacccatacgtcgattgcttacttaattgcggcacacgtaattttgatggtcggcgctccgttagcaatgtctccagcgcaaacgtacgcgttgaattcattacagggagcacaatctggtgatggaagtaccatcatgaacactatgcaacaaattgtaggtgcgattgcgacggccttggcaactagtttgttgggaattggccaagcggcatatcaaaatcaccatggcagtggccacttgagtgcagcatttacgaacggaacgcattacggattttacttcacaattgcgttaatcgtggttggtttattagcttcattgagaattactacggctaaggatgctgaaaaataagcgattaagccactaaaatagccttactgaaatagatttttcagtaaggctatttttgtgttagctgatttcttagattagtgggcggaagtgcttaaaagtgactgctacttcttttgccataaaaacttaatcaacgcacggttaacccgggcattgttatgcaacttgctgtgttgcgcgttttttccctggatttcaagctccgtgtacgacttggctcgcggacttactaaatattttagcgacttggcagaatttaccggcacggcttcgtcagaatgactgccatcgtctaaatcgccataaatattaagtacggcagttgaagtaggaaaatttttgcgcaggttaagcaattctcggtaagcaggggccatccagcttggcttaccagtagcctggttaacggtagcttgctcactcttcttttcacccatcagcccgttgtaatgccccgcaattgctaccaagtgagccacctgaggaagcttggcattgtgcaaattatcattgagataattgataatttcaagatttcccatcgaatgaccaactaggttgattgagtgataatgatgctgtttttctaaagcgacgacaatttgtttaatgtattcgccaccacgatgatatccgctaacgtaatcttcgtggtcattatttgccgtcagtttattatccgctaagttaacttccacaatggggttaattgcgtccgcggggatggagtggttaaacgtaacttgaccatttttagcaacgtccgcgcggactacggtattagttaccccggcttggcgagctgcgtccaccattttttcttcggcgtgaaagctgctcccccagccatggacaaataacgttggagtggtggactgaacgtattttgcggtggttgatgaacgatgcggacccgtcaagtagactattccagttgcgataatcaacaaccctattaaaactaataatatttttttcatcaaatcctccttaacattggtgaaattcccgatggctttggaattgttcacattatatccgcaattatggataatgaaaaatatttatttttaatcgttaaggataatgattcgttatataaggcagtgtaatcttaataaattgaaagttctcgtaaatccgctcgggccttttcttcggcgtttaaatcttgggtgatttgcccgtttcgcaagactaaaagccggttaccgtatttgaccgcgtcgctaagttggtgggtgatcatcagggcggttaaatgatccgcagtaatccgttcttgggtagccaccattaactcggtgctggttttggggtcgagggccgccgtgtgctcatctaacaaaaggatttccggtcgcttgatggttgccatcaagaagcttaaagcctggcgctgtccaccagataggcttccggttggggttttaagccggtcgctaagttggttaggcatgcttgcggtaatctgtttgaattcggcagtatgttggtttaagcggcggggacgcaatccgcgacgttgtccgcgtttcgtagctaataataggttttccgcaacggtcatgcggggggcggttcccaacttagggtcttggaaaacccgactaatgtagcgagtccgtttttcttcggaaaggtgggtaatgtctttttccgcaagcaaaatctggccttcgtcaacggctaagtttccagcgatcacgttaaaaagggttgatttaccagctccgttagaacctaacaaggtgataaagtcgttttggtagacctttaagttaatgttttttaaaatttggatttcttcgctagtgtgccggttggcgtagacggacacgttttttaattctaaaattacttggttattcatttgaatcacgctcctgactaattggtgaaaggccgcggcggacaatgttggataaacgcagcttttggcgtaaggttggcaacattaggcaaagggccagtactaatgaagaaattaagtttaaatcattggtgttaaagccggccttgaggactaagagaagtacgaaccggtagatgatgctaccgcaaaccacggcaacgagacgctggttcatggtcagctcgccaaaaactacttcgccgataatgattgaagcaagaccgattacgatgattccaattcccatgttaacgtcggaataaccgtcactttgggcaatcaaggcaccagagacggcaattaaaccgttggaaaccatgaggcctaaatttttcatttggtcggtgtgaattcctaaagattttgccattttttcgttgtccccggttgcaatgaaggcttggccaagctcagtttgcaagaaaagcgctagaagggcaaccaccacggtgataattaacaagcctaatagtacgctatcgaagaagggcggtaatgaagttaggaacgcaccgctaaacaaggtgtgatgtcctaataaggatacgttcgaagtccccataattcgtaagttgatggagtagcaggcggtcatcactaagattccggccaataaaattggaattttacccttagtgtacagtaaaccggtggtcagacctgctaacatacctacgccaaatgctagtacggttgccaaaagcgggtctactccgtgagtaattgcggtcacgctcacggctgctcctaacggaaaggtcccttccacggtcatgtcaggaaagtctaaaatccgaaaagttaaaaataatcctacgccaaggagcccccacagcaacccctgaccgatagcagaagtaattagattcatttgtaaataaccccttccttttgtgctttttgtagtaagttattaggaattttaattcccatttgttgcgcttgttttaagttaatggttaggtcgccgcgtttaagatattcgaccggattttcccgaactttttcaccctttaaaatccgcccggccatttttccagtcaacacgccgagtttatactggttcacgctgtaagtagcaattccgccatttttgaccatggaatcgactgctgggaaaacgggcacgttagccgcgttggtgtttttgaccaacgttgacatcgctccggcaatggtgttgtcggttggaacgtaaaccgcgtccaccgcctgggccatagattgtgaaacctggttaaggtcgttggagttcgcgatggaatacgccttaagattaatgcccgccttctgggccagttttttaaattggtggtactgggtcacggccgagttgtcactagaagtataaatgattcccaaagtgtgcaaatgtggcataagctgctgaattaattgcaattgttgggctaacggcgcctggtcggagacgccggtaacgttcgtagtcggatgctttagattggtcattaaacgagcacctttgggatcggtaatcccgctcataatgaccggcgttgtgccagtagtatttgctaaagcaagggcggctggggtggtaatcccaatcgataggtcgaccccttcgttttcaaacttctcgctcatggttttgaggttactctgatttccctgagcattttggtagtccacctttagattctttccctcggtaaacccggtttgctttaagccaacgtaaaccccgtgttgaatttgttttaaagctggttggtccattagttgcaggatgccaatccttttagtggtttggctagcctggttggtagaatttccttctttgaaaaaggcaaatcctagaaacgcaaaaatgatgacgataaaacttaacattcttttcatacaagcaaagctccttaaaataaagtaataaaaaaggacaaacccagagggcctgtccaaaaaaggcccgcatggcggttaatgatccatgcgggcgattatcagcgttattcaacacaaatgagccggcacagatacgatctgtatacaggtcgtatcttgcctttgcaaaacacaacctagttaccggctttgccaaccattattgacattttttcgttttaaaatgctcatttgcttattcctaccttacaagttaatcttccatgagtataacggaagactttttagtttgtcaacgacgatttaaaaattacctagctctggttaatggcatggaagtagaaacgggtgccgcgatctaagtaataagttttcgagaagttgaataagacgttattcttccggtaatgcgactggtaaagggtgatatagcgatcgccttgaggaaagccggtaatggacgcagcttctggcgataacggttcaatgccaacgtattggtcgctcgaatcaacggtgacatcgtattcggttttaataaactcgaggattgattcgtgcaggacgtcgactggtagaaagggaacttcattgcgttcgtaataagcgtattccaatatataaggctgatttttacggtaacgataccggatgattcggtatagttcatcgccatcttcacaaccaaactcattcgccatggcccggtcggcaatcatccggtcgaaagtaactacccgagaagttagcttttggtgattaaacccctcggaaacccccatggtgaggttaacgatccgatcggtgtccgcgccaatattattaatgtagtatccgctgccttgaacccgacggacgagtcccttttgactaatgatgtcgatggccttacgaattgtgttccggctaacgttatacttttgcattaattcgtattcggtaggcaattttaccttgaactgctggtgatttattttataaatcaaatcatttgcgataaatgtatacaattagtgacaccttctttatctggttttaataacctggtgacaaatttaaatgtttggcacttgtaaaatttgtacctacgttttataattcaattgtaacgtaagcggtttcatagtcaaccgcctaaattaaatttattacaggagtgattcatatggctgaaaaaacaattatgttagtatgtgcggcaggaatgtcgactagtttactagtttccaagatgcaaaaagctgcggaagctgaaggcgttgacgcggaaatctttgcaacagcggcatccgatgcggataacaaattatccgaaaaatcaccagacattttgatgcttggaccgcaagttcgttatctagaagacaacttcaaaaagaaattagacattccagtagaagttattgatatgcaagactacggcatgatgaacggcgaaaaagttctcaaagaagctttatcagcaatgggaaattaagtaacgttgtgaattttttaaaagcgctttcacttaactggagcgcttttttgtatcgaaaggggtaaattaaatggctgaacaagaacaagatatgcaagcaattatgggattaattattaacggagggaacgcaaagagttctgctttcgaagcaattaacgctgctaaggaaggtgactttaagcgtgccgatgaaaaattgaaggaatctgacggctttttaactgaagcacataacgcccaaaccgggatgttgactgaagaagccaacggcaaccatgccaaggtaactttattaacggttcattcccaagatcacatcatgaatgccattactttccgggatttagccggagaaattgtggacttatataagaaattagctgaaaagtaaggtggagatttgatgacggaagaaaattatcggatgcccgctggtttcttatggggcggcgcagttgcagcccatcagtttgaaggcggatggcaagccgacgggaagggcgttagcattgcggacgtcatgacggcaggcaataaagatactccgcgtaaagttacggacggagtggtggatggtgagatttaccctaaccattggggaattgatttttaccatcactatcgcgaagatatcgctctttttgctgagatgggctttaagtgctttcggacttcgatcgcttggacgcggattttccctaacggcgacgaaacggaacccaacgaggccggattaaagttttacgatgacgtttttgatgagcttttaaaacatgatattcagccaattatcaccctgtcccattttgaaatgccttatcacctagtaaaggaatatggcggttggactaatcgaaaactaatcgactttttcgtccggtttgccaagacggtaatggaacgttatcgcggtaaagttaaatattgaatgacttttaatgaaattaataatcaagctgattatgacgatccgcacccgctgctccaaaactcggggttgctagttacgaaaactacgccagataaagaagcgttaatgtaccaggcggcccataacgaaatggttgcaagcgcgaaggtggtcaaattggctcacgaaattgacccagattatcaagtcggggcaatgattgccatgtgtccgatctacccgcttactgctaaaccagcggatattatgaaggctgaacgggcaatgcagacccgctattactatggtgatgttcaggcgaatggtgaatatcccgcatggctgttgaagtactggcaacggcgtaatatttccgtggacatcagcgatgaagaccgcgaaattttagcgcagggcacggtagattacattggctttagttactacatgtcctttacgacaaaggctaatgacgacgatcccgactacgcctaccgggagtctactgatttagtggataatccgtacgtagcaaaatcagattggggctggcaaattgatccaatcggtttgcgttattccatgaattggatgcaagaccgttggcataaaccacaattcatcgtggaaaacggttttggcgcttacgatcaaaagaccgccgatggccaggttcatgacgactaccggattaagtatttccatgaccacattctcgagatggaaaaggccgtcgtgttagacggagttgatttgattggctacactccgtggggatgcatcgatttaatctcagctagcacgggtgaaatggccaagcgttatggctttatttatgtcgaccaagatgacgcaggtcatggaagtctagcgcgttctaagaaggattcatttgcttggtaccaaaaggtaattgcttcaaacggggcggatttaactactaattaattaaaaccgctgacgtcctgcaggtcacaaggttaatgccgttttaaggaggtgatcaaggtgtttagttacgaacgaattcagaccctcaatcaattagaaatgtttgtttataagtacgttgccggtcatcttgaagaatgcaaaacaatgacgattcgagatttatcagctaaaagtcacgtgtcatccactacggttttgcgttttttgaagaaaatgggttacgaaggattttccgatttcaaatatgcgttgcgacatcatgatgaacccgatcggttcggacaggtagaacaagagtggggaccaattgcccaatttttaacgcaagctaatttgcctaagtatcggcaaaaaatttccacggtagcgcagttatttttaaaggcgcacacccgcctctttttagggatgggatcgagtagcagtctagcacagtacggtgcccgagtgttatctaattatggattgttttctttggcaattatggatccgtatcagccgcagccgattgagggccgggactatactaaaactttgatcatgtttttgtccgtttcaggcgagtccgatgcaattttgcgacaagccaattattaccgacaaaatggggcgactaccgttgcggtaacggccaaccacctttcaacacttgcgcaggtttgcgaccattgtttggcatacgacattccggaaaagaaagtggggacgctagacttcacttctcaagtaccggtagtttacgttttagagcaaattggtcagcggtgtggcgagctaatgaaagatactaaggtgagtcaccaaggttaaaaatagtgttatgaggacggttaattttaagcaaaaaagttgggaataaaaattttttcgtgaattttagtcccaacttttttatgcttccaaaagccaatgtgctaatttattcccaataaatcaacagtgttaactattaggttcaatagccgggataaagcgagcgtttccaagacttgtgtagtagttgacaaacggttgaaaacggttactatttagttataaacaactaggaggttggttacttatgaaaattgctatagttggttgtacacacgctggaacctttgcagcacaacaaatcttaacagaacatcccgattacgacgtgacggtttacgaacgtaatgataatttgtcattcttatcatgtgggattgcactttgggtagggaaccacgtttctgatccaaagaaaatgttctattcatcgccagaagcgttgactgaacttggtgcaaccatgaaaatgaagcatgatgttttagatatcgaccccgatacaaagactttgaaagttaaaaatctcgcaacaaatgaagagtttaccgatacatacgataagctagttatgacgacgggttcatcgcctgtaattccgccaattgatggaattgataacgaacgaatcaagctttgcaagaactggaacgacgcggcagaattaaaacggattgacgacgacgttaagtccgcagtggtaattggtgcaggctacattggcgctgaattggctgaacaatatgcaatcactggccgtgaagttaccttgattgatggtttaccaaacgtattggcaaagaactttgaccctgaaatttctgaccgggttgccaaagactacactgaccacggtgttaaattagcaatgaacgaaatggttcaaggctttagcggaactgatcaaattaccgttaagactgataagggtagttatacagcagattacgcaattctctgcgttggtttccggccacatactagtttgctaaagaacaaggttgatatgctcaaaaacggtgcaatcatcactgatgaatacatgcaaacttcgaacccggacatttttgccgcaggtgatgcttcagtagtgcactacaatcctactggcaaagacgattacattccgttggcaactaacgcagttcgtcaaggaattctaattgggcataacattgaaaaaccaaccgtaaaatacttgggtacccaagcaagttctgcggtagcactttttggtaaaactttggcaagtaccggtttgaccgaaggtggcgcacaagcgcggggcgtggaagttgattcggtaactcttgaacaagattatcgtccagaattcatgcttaccactaccccaattttaatgcgcttggtttgggatccaaagacccgggtagtgcttgggggtgcgttctacagtgattatgactgtgcacaatctgcaaacaccgtttcgttggcaattcaaaacaagatgaccattgatgacttgtcgatggtggacatgttcttccaaccaaattacgaccaaccgcttaactacattaatgcgttagcgatggcggcggttgccaaggcagattctaagaaatagtaaactgattttaagcagaagggaatcctgagcatgaacaaatcaaagtagcgatggttacgggagctgcgcaagggatcggtaaagcgattgcgttgcgtttagcacaggatggtttcgcagtgggagttgcggatttaaaggccgcaaccgcccaacaagtagcggacgagatcaacgaccgcggacaaaccgccattgctgttgaagttgacgttgctaatcgagatgacgtgtttaaggcggtttctcaggttagtgaacaactaggcgggtttgacgtgttagttaacaacgctgggttaggtcccacaacaccaattgaaaccatcactcctgagcaatttgataaggtatatcatgttaacgttgctggcccattgtggggtattcaagctgcagttgcacagtttgaaaagttaaaccatggtggcaaaattattaacgcgacttcgcaggccggagtagtgggaaatcctaatttagcactctactcgggtactaaattcgcggtccggggaattacgcaagtggctgcgcgagatttggcagacaagggaattaccgtgaatgcttacgcacctggaattgtaaaaaccccaatgatgatggacatcgctcatcaagtcggtcaaaacgctggcaaagatgacgagtgggggatgcaacagttcgcaaaggacatcaccttaaaacgactttcggaaccggaagacgtagctgcagccgttgcgttcttagctggtccggattccaattacgttaccggacaaaccatcattgtggatggcggaatgcagtttcagtaagtcagttttaatttagctttgaactagttcagaacgagaattacatcgttctgaacttttttgttgtgacggagaattgtaaaacaatggtgacggatgaaattttagcgattgttatttaattaatggtgggcttgcgagatagtcaaaatgcgttcccaagcccaaactttccggtggaacaaaagtttaatttgcaatacagactaaacgtgctccagcctccaatcttttccggttagtaaaattatgcaatcaatcgccaaacctgcgattaattacataattaaactaatcctcaaagattacccggaggcttccgcactctctcaattgagcaccatcctcgcctttttttcctttgttttgtacaattactttaataaaaatgataaattgctaacatttagaacgttaaatctccactgaaagcggttttattaatcggtaaaatagacccatggagtgaaactatttttattgttttaactatgtatcgtagcccgggctcggatgaattatcacgccaattatttcgatacggttagtttaaaacaataaaaaatttgctcagtgtcctgattgaggggttaccgaaagcatttgtcgtatttaactagttagatatttttacgcgtatttaagagtactagctaaaacgttgctactagtgagatcgatacggattgcttcatcaatcgtgattaatgatcgccgctaaacaactaaattttaagtaaacagtcaaattattaagtgagctgattgttctgctcacggacacaaactttttagaggtgatcaacttgtcagaaaaaaagccgcccaaaaaaattggtttattgccattatgtgcgctagtgattagttcatcgatcggaggtggggtgtttggcctaccatccgatctagcacgtgcagcggctccgggaccggtgataatcgcatggttaattgtcggttttggaattttaatgttagctttgtcattaaataacttactgcttaaggaaccgaagctggaaggcatgttttcctatgcacaaaagggattcggaccgtttgcaggttttattagtggctggggatactggttgtccgcctggcttggcaacgtggcgtttgcaaccatgatgatgagtgctttggggtatttcttccccgtctttaaatcaggacaaaacttaccttcaattttgttagcaagcgtcttgctgtggtgtttaacctactttgtcagtcagggaattgaaggcgctgcgattattaacatggtggttaccattggtaagctagtcccgttgttcgtttttatcgtaactgcaattattttatttgatgggcatctttttacccaagctttttgggataacgtaggaagccactttgtagtcagtgacgtaatgcagcaaattaaaaactgcacgatggtgatgatgtgggtcttcgttgggatcgaaggggcttccaccctctccgcacgggcgcagaagaagtcaactgccggaaaggcaaccatgtttggtttgattagtctattagcaatttacatgctaatctcaatcttgccatatggctacctaacccggacgcagttggcggaccttcatcagccagcgctattatacgtctttgcccagatggtaggtccttggggcggttacctgattggcatcggtctaatcgtttccatcttgggtgcgtggttgtcgtggacaatgctaccagcagaaaccattttgctaatggctaagcaaaagctattgccaaagtattttggtaaggtcaaccggcataatgcaccaacatttgcgttagtaatgactgcgtttttagtacagggctttctgtttaccttgttgtttacctcgcgtgcgtataactttgcttattcgctttgtacggcttcgattatcgtctgttatatcctagtagcagcgtaccaaatcaagtattcctatcaacacctaaacgtaaaggggaatcgggcgcaactaatgattggagttttcgcgttagtatttgaagtcgtggggatttggatggcaggaattgagtacttattactctgtttaattgcctacttaccaggtatttacttctacgggaaggctcgtcaggaaaatggctgcgcagtccgcttgtcgcacaaagaaaaattagtgaccgggttgcttaccgcgggtgcgctattgagtgtgggtctaatgtttacgggcggaatctcgctttaggaatgtgttatattagaactttggttacttgatttaagagctaagaatcatcagctaggagtaatgatatgacaaacgagcaggattccattcgggataatccgaaaaagtatttaaaaactaaaccggaatttagtgattttaccgatgcagagttgcaacagcttattaaccaaatgcacgtaaagcaatttcccaagggacaggttttatttgatcaaagcgatgatcgagaaaatttgtactttgtgattaaaggtttggtacgagcggagcgaaccgatgcaaacgataaattcactttttatacatacattaaggccgaccttgcttttccttaccggggaatgtttacggagtgttattatccgtacacggcccaggcaatgaccgatattgaaattgtctattttccaatgtcagtttttgaatcgttgttacgacaaaacaacgcggcgttggtcaaggtggttaaggaaatgagttcaatcattagcgaatcagaagatcagattcagcagttagttaccccaagcgcacgacaacgaattgtccaagcgttgaaaacttttgaagctgatttaggacagctccagccggatggtagttctaaaattccgtatcccctccgcattaaggaattagcggtgatgagcggaaccagccgggagactgccggacagattgtcaaatacttggtggaacaaaacttaattgattatgaacataaacggtttgtttttaaacctgaattttttcaggatgaaaatgacgactaactaacaaaattgaaggcacacaattaaataaaactaaaaaagatggtcaactggcgtggggcttatttttaaagagcttctgcaaggttgaccgtcttttggtaagggagtgtgccattatgttaacaaagggagaacggcgttttaagcttaaaatgccgggagcgtttgtaattttattcattttgacgattgtggcggtaatcgctacgtgggtagttccttcaggaagttacgcaaaattggcgtacaaccaagcaaactcgtctctacaggtaaaacagcctaacggacaggttgaaaaggtaccagctacccaaaaagaattggataaactgggtgttaagattaacattcagaagttcacgtcgggaagcattaaccaagaaatttcaattcccaacacctacgaacgcttgaagcagcatcctgcaggagttgatcaaatcacttcgagcatggttaacggaactatcgaagctgtcgacattatggtgtttatctttgtgttaggcggtttgattggtgtggtaagggcaagcggggcctttgaatccggtttactagcgctaacgaagaaaacgaaggggcacgagttcctgttaattttcttagtagcgacgttaatggttctaggcggaacgttatgcggaattgaagaagaagcggtggctttttatccaatcctcgtgcccgtcttcattgcgatgggctacgattcgattgtctgtgtgggagccattttcttagctagttcaatcgggacggccttttcaacaattaacccgttttccgtagtaattgcctccaacgcggcggggattagcttcacggaagggttaccatggcgggcctttggttgtgtagtggcggcgttgttcgtaattggctacctctactggtacagtaagaaggttaaacaaaatccggcagcttcgtactcttacgaagaccgggatgaatttaaccaaaaatggtcggtaataaataatgatgaacaacaagcagcgtttaccttacgaaagaaaattgtgttagcgctattcgtagctggttttcctttgatggtttggggagtaatgacccagggctggtggttccctaagatggcggcttcgttcttggcctttgccattttgatcatgattttaacggcgactggtaaaaatggaattggggaaaaaggtgtcgttgacgcgtttgtcaacggtgcttcgagcttagtaggggtatcgttgattattgggttagctcgaggaattaacttgattttaaaccaaggaatgatttccgatacaatcctggacttttcctcgtcgttagttgcccacatgagcgggccggtatttattatcgtgatgttacttatttacttcgtcctgggcttcattgtgccatcatcttctggtttagcggtactttcaatgccgattttggcgccgttagcagatacggtacagattccacgttttgtcgtggttacggcctatcaatttgggcaatacgcaatgttgttccttgccccaactgggttggtaatggctaccctccaaatgctcgacatgaaatattcccactggttcaagtttgtttggccggtagtggttttcttactcgtcttcggtgggggaattttagtggcccaagtcttgatgtattaaaaacgtatcgatataaaaacaggagcttagttagctcctgttttttagtgtcttataaatacaatggctagaaggccatgttgcattttggtcgcaaagggtatcttatggtggaaattagcaaaggatttccagagttaggaatcctgtaaaatagccgcgacccgacgttttaagtctggaaccacttgttcttcaaaccatggatttcttgccaaccagatattatttctgggtgaagggtggactagtggaaaatactttggtaagaacgattggtaattttttaccaactccgtggtggtcgtcttcggagtggtttttaagtaataacgttgcgagtaagcaccaatcaataaggttaattggatattaggcatggcagccaccatctggggatgccatttttcagcaacggccttacggggaggaatatccccacttttaccttttccgggatagtaaaaatccattggcagaacggcgattttgccagaattgtaaaaggtctcgcgtgaaatgcccatccagtcccgaagccgatcgccactcttgtcattccagatgatttctgtatcctgcacgcgtttgccgggcgcttgaccgacaatcaggatccgcgcttggggattgagcatgtaaatggggtgccatcctttttcagtaaagacggcattttgggggtcttgcatgatttctttgaaaaacggcatttggtaatccaagcaaattctcctttctattaggaaactatcttcagtatacatcattgaaaacgttatcttgagaataacgctagcaactagcgcgttctttgttataattatcagagtaaatagtaatgattactctttaggaggaagaagatgcgcttaagacgaagttgggtagcaggactagttttgctgctaactggggtagtcttgcttggaggttgtacggcaactaagcagactgattctagcaaaattcaagtagttagttcgcttaatttttatggcgatgtcgcaaaaaaggttggcggtaagtacgtcaaggtgacgaatattattcaaaatgcggcgactgatccgcatgattttgagccaacgaccaagacggctaaacttatggtggatgctgatttagtaattgaaaatgggatgggaacggacgcctggatgcaacggatcaccccgcataaaaagggacttcaggtgattaatctcggacatttgatgaacaaaaagaatggtgagaatcctcatttatggtacgatttggcaactatggaacgtctagcaaaccaggtggctaaacagttaagtaagaaagacccgcaacatcgcgaattttaccagcgaaacgctcaaaaatacgttaaatcgctgcagccaatccagaagaagattgacgaaattaaacaacaaagttcggggaaaaaagttgcggtaaccgaaccggtttatgattacaccttgcgggagttaggttaccaaattagcgaccggaaatttgcgcttgcaatcgaaaatgagaccgatccttcaccaaaaacggtcgaaagcctgcaacaagatcttaagcagcgtcgagtggaattcatcgttaacaaccaacagactggtaataaggtaatcgatgaagttttaaaaatggctaaaaaacatcacgttcccgttatcaacgttacggagacgatgccggacggtaagtcgtatcaagagtggatggttagccaactaaatcaaatcagtaaaataataagagggaaagattaatgacggagacattggtacaagtacacgacttaacggtcgagttcccgggacaaaaacttttcaatcatttaagcttcaacattgaccggggcgaatttttaagtgtaattggtgaaaacggggtggggaagaccactttaattaggacgttgttacaccaagttaaaccgactcacggggagattaaatttcgatcggcagtgaacattggttacgtgcctcagtttagaaatattgaccgggattacccattatccattcgggactttgtagccctaaatttgcaagaaagtcggttaccgtggttatccaagaaagaacgccaacaactagacaaaattttgcaagaaacgggtttggtagaaattcaaaatacccggatgggtcgggcgtccggtggacaaaagcaaagggcgtatttagctcaggcactggtcgatcagccggatttgttaatcttggacgagtcgactgcaagtttggatagtgttcgtaaatacgaacttttcgacttggtgcaacattttaatcggcggcacggattaacggtattatcaattacgcacgatttcgatttaatgaaaaaatattccgacaagtacttattgttgaaagaagaccggtacgcgttgggcgaagtcagcgatattcacagtgaggaggatttgcccaatgtttagttttgaatttatgcaaaatgcctacatcgccggaactttcatcgccattatttgtgggattatgggagtctacgtagtgggacgcaacatgtcgttcttgtcccacatgctttcagaaattggcttttctggggcagcgttcggaatttttatgggatggcaagccttaacggggatgttgctgtttaccattgtgagctcaattttgattggtaaaatgagtgtgcaagcatcacgacgagaatcggcaatttcagcagtttcaagtttgtttttggggcttggaatcttatttctctcaatttctaacaaaaacgttagttacgctactaacattttgtttgggagcgtaattgggattggccggtcagaagttcgccaagtattgttgctcaccatcgtggccttagccttcatcttgttgatgtaccgaccgcttaagtttgattcgtttgatcacgtgggtgcttcggtaaaggggattcacacgaattttatttcaattatctttttagtagtgttagcgttgagcgttagtacggcagcccaaattgtgggttcactgttaattttcgtgttgctaacgttaccggcagccgccgcaaaaattgtggctaaaacggtgagtggcatgatgctgtttgcggtaggcgccgctttggtaggcgtttggctaggactatacttgggctacgtaacgagttggccggtaagtttcttcatcgcctcaattgaatgcatagtgtacttttcagcgatgctgctggggagaaaagattagtgtgtcccaaaattggggacgaaatttaaaaattaaccagctaaggggatgggtcgcaagtttggcgattgatccccttatttaattgggcggagaaattggggtgcctaagtgtgatggggctacgcaagcagtaaatggtagtttccacccaatacatagcaatttaacgattgaaaagggctgttttccggttctttttacatttatgaatttttgcaataaattatattaaggttttcgcctaaacccgaacattatccttgaactgtggtatgatattggttaatgagaacaaatatctaatagacaaacgaagtggagtgaaagcaatgaaactgaagcgtagtgaacggctgattgatatgactaactaccttattaatcatccccgcacactaataacttctggatttttcgttaagcgatattcatccgctaaatcttcgattagtgaagatttatcaattatgaaatcaactttagcaaaaagacagttaggaaccattgaaattactaatggagcggctggtggaattaaatatttaccgggaattgggaaagcagaagcccaaaaggttattcaggatctcacggaacaactttcggatccggatcgtaagctgcctggtgggtatctgtatatgtccgatttattggggcacccggacaccttgcgtgcaattggacggatgctagctagtgagtacgtattttccgacgtcgatgcggtaatgaccgtggaaactaaaggaatcccgctagcccaagcagtagccaactatttaaacgttccgttcatcattgtgcggcacgaatcggtgattacggaaggttcgacaatttcggtcaattacgtatcccgctcttcggaacgtatccaaaaaatggagctttctaaacgcagtttacagcgcggaatgaaggttttgattgtggatgacttcatgaagggtggcggcaccgttcatgcaatggtcgatctgctgaaagaattcgaagcagaattgattggaatttcggtactagctgaaggaacttacaaaggacaacgggcaattgaggacttcacttcgttgttgaacgtggacacttcccaagccggacaagttcaaatcaaggccggaaactattttgaaagaaattttaaagaagacactaaggagtaattgtagcaatggtgaaaagtacgattattttagcagcgggtcaaggaacccggatgaagtcaaaattatataaggtattacatcccgtttgcggtaaagcgatggtggatcatgttttaacccaagttgaaaaaacggatatggaccacgtggttaccgtaattggtcacggtgcagaaaaggttcgggaattgcttgggaaccggacggaatacgcggttcaaaaggaacaacttggcacggggcacgccgttttacaagccgaagacattttaggcgacaaagacgggattacgatgattgttagtggcgacactccgttgtttaccgataaaacttttgaaaacttatttgaatatcatcgtcaaaagggcgctgcggctacaattctcactgcgcggaccgataatccgttctcctacggccggattgtgcgtaacgaccttggggtggtggataagattgttgaacaaaaggatgccactcgtgaagaagcagaaatcacggaaattaataccggagtttactgttttgacaatcagaaattgttcaaggctttgcaccaagttaaaaatgacaatgctcaaggagaatactaccttcctgacgtaattggaattatgaaggcggctggcgaaattgtcgcagcttacgaaatggatgactttagcgaatcaatgggagttaacgaccgggtggccctttcgaaggcaactaaagtaatgcagcaacgcatcaacgaagtgcacatgcgtaatggagtaaccattgtggacccagagaatacatacattgattacgggattgaaattggcactgacaccgtaattgaaccaggagttcaactacaaggtcaaaccaagattggttcggactgcgtgattggcgcgcattctaagattgtggattcgactattgaagaccgggttacggttacctcttcgcaaattgaacaggccatcatgcaccacgacagcaatattggaccaaatagccatttgcgcccgaaagctgaaattggcgaatttgtccacgtcggtaattactgtgaagttaagaatgctaaattgggggcccggactaagatgggtcacttaagctacgttggggatgcagatgtaggtacggatatcaacattggttgtggcgtggtattcgttaattacgatggcatcaacaagcatcacactacggtgggtgactactcgttcattggtagcaacgccaacattgtggccccagttaaattagcggaccacagctacgtagctgctggttcaaccattactggcgacgttaaccaatacgaaatgggaattgcccggggccggcaagttaacaaggaaggttacttcaaaaaacttccggtttacgaagcagctttagaagctgaaaaagaaaatcaacgtgattaatcattactaatttgatccctcaagcacgctgaggtcacttttcttagaactacaattattttctgaaataattaaataaaagcaggtttaaaaagtttgtttatttatattaggcaatcaatttccaatattggaaattgatcgcctaattttgttaatatgtgtattatttcaagggctaatggagttttgcacagctttaattactttaggcttagggcttttaaattctatttgattatagaacttttcaaacctttgtgtggaaaaacgtatctatagggcattatcagcagatgtttccttttggggacatgtttctgatgatgcctttttctttgtaataataaattcttaaaggggtatctatttattgagaatgtaaacaaaaaattatttctaaatagttcctttcgcaatttgaataatgtaattaagaggacaattagataaaatcggagcttcttatcccattagaagtaagttgttattaatttgtagatagattttaggtgtttatcagcataaatttcattaaagttttgactaatttatttttaaatgatattatgaccatgcctttgtgaccgattggtcacggaaaacatttcagaaagtaggtataaaatgtcagagtcgattgtgtctaattatgaacagtggttaaacttagcagaaatgcctgagaataagcgaaaaattctggaagccactattaaactttattcaaaacaggggatatccaacacttcgaccagtcaaatagcaaaagaagctggtttatcaaaagctctaatttttaagttctttactaataaacatgatttaacgatgaacttaattactcctgtcttggatcatatactaccagtttttacttccgatttttttggagatcttgaaaaaaacacagaagtaaaagagattatccgttacattgtttttaatcgttatcaattcctcatagaaaataaagacattgtcttaatttttttgtccgaaataatggtaaacgaagagttacaacaaaaatttttttcgtatattgattccaacaacaaaattatgtggttaaaagaaaagccccattttttgaagattaatgaacaaatcacgttatcgagtttgtttttggcaattgctagtcagattcttatgctgtttgttcaatgtacgatttttaataaagaaatgactaaacaacaacaaaatcaacgcttagaagagatcgttaccttaatttacaatggggttaaaaatagaaaggaataacagctatgtatcttgcaataaaagaaattttgcacaacaaacttcgctacagtctggtcctagttacaatttttcttatatcttttatggtctactttatgacaagtctagcaattggtttggtacgagataatcgaaccgcagtggataactgggattcaacacgagtaacactttcaaaatattcaaataagaatttaacagcctcttttatcactgagaataaatataaagataaactgtccgatgacgcggttcccctaggatatatgttcgctgtaacaaataaaaaaaatgataacacgacagtgaatgcttcaatttttgctcaaaattggaacagctttattgctcctaaattaattaagggtcactatcctagaactaaaaatgaagtggttattgatcaatcaatgaaaaattataatatcggaataggtgatcatatacagttaaatggaagtacagatgaatataaagttgttggtctaaccaataatagtaaattttttaccatacccgtcatttatactgatttatccacctattggaaactacaacatactgaaacaaccacaaaaaccatctcagccattgttcaaaaaaataatgttaatatttctgggaaaggattagtgacagtaactgcacaagatatgataagtaatattcctggctacacaccagaagtaaatgtgtttatggggatgattattgctttagtagtaattacttgtttagtggtcggtattttcatttacattatcgtgattcagaaatttggactttatggcattatgcgtgcacaaggtattcaagccaaaacaattatctggtctctattttgtcaaatattcgtcttatcaggtatgggcgtcttactagcgcttgttggtgtatgggcagtaaaatttgttttaccatcaacacttttcttctatcctagctggcaagcctattctcttctaagtttagcaattattataatggctctcttagggggactattctcgttgcctaaaattttgaaaattgatcctatagaagcgattggagattaaattatgaatttagtaaaaatgaagaatgtcactaagaaatatgggagcggacatacgctaacacaagctctatttcctactaattttgaattacaggaaggagagtttgctgctatcatcgggccctcaggatcaggaaaaacaactttcttaaccacactgggaaacttacaaacgccaactagtggacaaataatcataaaaaataaagatacaacacagatgaatgaaaaagaaaaaacaaccttacgttttaaggagtttggctttattttgcaagcgtcgaacctgattccatttttgaatattcaagaacagttagatttaatagatcgtttggacaagtcaaattcaaaaaaatgaatcgagaagaattattagatttgttagacctaaaaaaggtactaaaatcttatccaaaagatttatccggtggggagcgacagagagcagcaattgcacgtgctttatacaataacccaagcatcatattagctgatgaacccacagctagccttgatacagaacgtgcccatcaagttgttgatctacttgcacgaattgctcacgaatataatcggggtgtgatcatgattactcacgacatgcgtttattagataaagtcgaccaagtttacactatgcaggatggaaaattgtcacgtggaaatgctttagaatatgattgataataatgtacgacgtccgcataaaagtaaaatcacgttaagcgactaacacctatgaaatagatataagattgcatatattgggggtatttagttgtacatgctgtcatcttctagaagtgaagaaggtgctcttaaactctattgtaaatatagaagcggtaaggaataaatacagcatattcttgtatttatttgcttgatactgattatttcgtttctatactgaaagacgctttattttttaattaaaatgtttttttcatgtttattaatctttactaaaatccatattcaattaacttatatagataaaactattttttggtgattaaggaaggttacttcaaaaaacttccggtttacgaagcagctttagaagctgaaaaagaaaatcaacgtgactaatcattactaatttgatccctcaagcacgcaggttgtttgagggattttttgtgtggatgggaattttaagcggtgtgacttctatgtttagaaaaagttttctataatttaagtagctaaggcaacggaaaaaactaaagaaggaaatcaaaatgaaagtgaagccaaaaatcgttggaaacgttattaaatcggttaatccttatggttgccggcaagcagttttaaatcaaattaattacgtaaagtctaaggggaaatatgcgggacctaaaaaggtgttaattttgggcggttcatcaagttatggcctagctacccgaattaccacggcgtttggcagcggtgcagataccattaacgtagcttatgaacgggggccaaaaagtcctgaacaattaggttctgcggggtggtataacagtatctttttcaaacaatttgctgagcaagctgggttgattgcgcaaaactttatcggcgatgcgtacagtgacactatgaaacaacgggtgattgagtacattaaaaatgaatttggcggaaaaattgatctgtttgtatatagtttagcagcgccgaagcgcaacgacccccggtccgagaaagtatggcggtcggttttaaaaccaatcgaccaaagcgtgactggcgaaaatattgatttagaacacgaacggttattcaccgaaacgattgcaccggcgactccggaagaaattcaaggaactgctaaagtaatgggtggtgaagactgggaatggtggatccaagcattaaaggaagcccatgtattagcagataactttaaaacggtgctgtattcttacattggtccacaaatgacgtatccgttttatcatgaaggaaccttaggggtggcaaaaacgcaagctgaaagatccgccgagcggattaatcaggaattgaagccactccaaggtcgagcgctagtttgcgtatcaaccgtagtgactactaaggcaagcgtagtcattccaatcatgccaaagtacatgattgctttgtacaaagtgatgaccgatgaggctacgcatgaaacaccaattatgcataaagatcgggtttaccgggaaatgatctatgggaaacatccaatttacgatccaaaaggacgactacgcgcagaccattatgaattacggccttcgacgcaggcaaaaacagcagccctataccaacaaattaatgcagataattttaaaagtccgatgacaggttatgctcaatttagaaaagaatttcttaatacggcaggatttgcggttgatggtttagagaatgatgagtttgaattctctgacttattaaatctaaaaccataataaatgaggtactcaaattttagagtttagtttaataaaagtatatgtgttaaatgaatctggataaatgttcatgaattttcatttcaggaaactttttaagataattgcaaaaaacaccctgcaacaaagaaaaaaacgttttttaaggaagaaaacttagaaactccccggaagtaacttgcttttatagtcgtaaatgaattatgatattatatggaaaaattgaataaactcaatatcttataatcttttggaggcaaacatgtctgaacattattccgatccaaagcttaaaattttcgctttgaattcgaacaagcccttagcggaaaaaatcgccaaggcagttggtgtagaactcgggaaaacatcggttgatcgtttccgtgatggtgagattcgtattaatattgaagaaagtattcgtggggatgaagtttacattattcaatccacctctgcgccggttaatgataatttgatggaaatgttgatcatgattgatgctttgaaacgtgctagtgccaagacaatcaacatcgtaattccatattatggatatgctcggcaagatcgtaaggcccgttcgcgggaaccgattactgctaagttagtagcaaacatgattgaacgtgcgggtgcaacccggattatcgcacttgacttgcacgcagcacaaatccaaggtttctttgatattccgctcgatcacttgatgggtgcaccattgttagctgatcatttcattgaacggggcttgaatgaaaatgcggtagtagtttctcctgaccacggtggagttacgcgcgcacgtaagttggcagaatttttgaaagcaccaatcgcaattattgacaaacgtcgtccacgcgcaaacgttgcagaagtaatgaacattattggtgaagttaagggcaaacgttgtatcatgattgacgatatgattgatacggccggaacgattactttgggagcacaagctttgatcgatgcgggcgcaactgaagtatatgctagctgtacacacccagttttatcgggtccagcgatcgaaagaattcaaaactcgccaatcaaggaattgattgtgacggattctattcaacttccagaagaaaagaaaattgataagatcacaagcatttcggtaggacctttgatcggggaagcaattcgtttaattcacgaagacaaaccggttagtccattatttaacaatcgttttagtacagaacactaatacgggttggcgtaccgatagcaaaagaataaatgaatgtagaggcaagaatgaatttcttaacctcttttttttatgtaccggctactttgaaagataaaactcattcaatttttaaaacttggtaaacaagccgatttttggaccctaaatcatttacaatagaattaataattttaattggagaagtgaattatgaaattttgtttgaactgtggcgaagaattacctgaaaaggcacatttttgccctaattgcggggctaaaatcgaaacagcatcaagtgaaagctcccggctttctcgtgcagaattgcttaaaaatcggcaagaaacaccattagacgatttgaaagaaagcgcggataccaaaccggaagaagaaccaacgattagtcgcactcgcagaaaaaatggcgcttctacggacctcaaggagggtgcgttaactacgttgcaatggatcggaggcaattggttaacggctctgctagttttgttagtaattggagcaattttttactggctaagtaaaatggttggggtagttttactggtggtggcggttgctgccgcatttttctacgctcaacgagtgggcgctggtgaccgtagtgcagaccaggctgtgaaagcaatccttcaaaaggggggcgaagcaggtcgtcaggtttggcaaaaattgcaaacggcgttactaaaaaaacgtggtaaaaaggatttcaccactccaactgccgaacaaaattccgattcaacggaagcagaggcagcggaagcgactgcggagccgaaatctatgaaagaaggggcttcatcaggggtaaatgatcctaaaccaactactggcactgacgtacgtaaagggaagcaacgctggacgttgaaaaataagttcattatgggaattgccattattaccggaatggctgcttactgggcaccgtttgcttcggcacccactgctgggtataacgttaaaacttcccttatgagtattttgaagacgttaggagacgatcagcttgctcactttttatgggtgattcccgcattactcttatttggagcgcttttgcaattccattggctgaccaaatgggcgagttacctaaacttgctgtggtacggaatgatgttctttttgatttaccaaaatgaagcccaattagttggcctaggtaacatgttcaacggagttcgttggggatggggcggctatttaattgtagcttgcagtattatcttattattaatgcattcaagaacgcgtactcgaaaataaagcatattatcaccgctacctagcctaggtcgatggtaatatgcttttttatgcaacaaaaaaggattctagacttctcacactagaatcccactaagaggaaaggcgttcccaatcaatcgtgatctctttattggaaaatttatcgatctttacaccttcaacttcaattacatattcaattgttcagccgtcgtgcttctaacctacctgaggttttgttattacgtctgctgctgcatgtctaatcaaacaaagggtttgacgaaggatacactcgttcaggctaacggtgaaatagacggtcttggagtttcattaagatattcttcgaaacgatagacctccagtgaactattgggtttttatttggaacagtgcctaggataattacctaagcgaagtatttatgtcattggacacacctacttgattcaatgcttggagatgacgttgaacattactctttaaaaagatgattgccactccattcatcaattcatcgtgcgtaaacacttaatcattacgacgtctctaaacgtcaaaactttttcacggtacgctcatgatgcaattgattagcgaatagagctaatattcttgccttttcgtcggttctggcaatctgagaaccaaggccatctgagaagtttttgattgaagaggaactatttcctttcctcaattagaatactatcacaacttgtaagcggttgcaatataaagactcgaaactactaaaaaatatttttgggtagtaaatttcaatgctaaattcgaacttactaagcgtcgtggaggcgattcgcgagttttgatagttatatttaatgtcaacacgttaatgtagtataggcgaaatgcattccagaacccaaatctctccggttactaaattaaggtattaatcgcaattcacgattaataccttaattctgttaagcctcaagatttacccgggttatggagcgctctaaactattccacccaaatcttcacacccttatagatgttgtaaatgaagagggccaaagccacaattcccattaatcccacaattaagaacagtaccaaagaggtggttggaaaatgatttctcgtaaagctgtgcgcagtagcgagaattcccaacccaaaacctaacggcaacaaaatgacgggaatgaggtgaagccaaaacgccgtaattgcgtgccgatgagcaggtgcgtactggacattactggtaagtaccatcacgataattggaaaaataattggtagaaaaaagatgctgaaatatgaaagtgaacttaaaaatttattttcggtagacatcaatctgctctccttaaattagtttaggcaatagatcagttttcaattgaaaaggtgacaaaaaggttgtttttgtaagtcgttaaattctgcggtaaaaattgttttatctttgtaagattattaattgataaaaataggggctcgaaaaaattctcgccccgatagtatataaattaccaaataaaagtgcaataccatttaaaaattgcttaaaacatcgttaagtaattacccttttttggcttccttagccttacttttagctcgtaattcatcctttagcttttcaatatcttcttcgtgagcagctttccatttcttgtatgaaaagcgagcatcggtatccgtatccccaattttcattccggtttcaagccagaaaactgcttccgataaactaccaaagttgcgcatccaaagggtgtgtccgtttgcggaatctaaagcgacgtaagaacgaaactttttagtcaggtaagtatgtttgcgaatcttgaaggcttttcgttgccgagttagcttgtaatcaggaagaatatagtgcccagggtgctttaaaacggggacgttatcctgccgttggctcttaaattctacaagcattgccttcgcggtgggttggtcgataatatttacgtcaaaatttgccatgtaaactcctcctgattatatttctagtaatattttagcataaatattaaccaaccgttctaacaaaccactactttataaatctcttaatttgagaatgcttctaaattggtatacaatgctatttgcattattttttattatttactatatagaaaggagaccatttatatgcgtaagtatatttcagaacttattggtacttttgtattggtctttgtaggaacggcagcagtaacgattgctcatgcaaacgtagttggaattggattagcctttgggttagccgtaaccattatggcttattcagtaggagcaatttcagggggacactttaaccccgcagttactcttggaatgtggattaacaaacggattagcggtgcagatgccgtttattacgtgatttcccaatttatcggagcggttttggcttccggaatggtgaagtacttcctttccgcaatgggtgcttccacagctaacttgggtcaaactgatttcactaagatttcggcgttccctgcgttagttaccgaagcattggttacgttcttgtttgtattagtaattctgttcgttactagcaagcaatacggcaatgccagctttgctggattgattattggcctaactttggcattgatgatcatcgcaaccttaaacttaactggtggttcattgaaccccgcacggagttttggacctgctattttagtgggtggcagtgcgttatcccacttctgggtttacgtggttgctccactagttggtggtgcagttgctgccgttgtagctaaggctctaggtagtgaagctgaataattagctgagtaataaaacaggctgaggattgggataatgcccaatttcctcagcctattttttatgccgattttttttacgttctaaattaagttcgcgctgcaagtggtcgactttatgatccaactggtcgattttttcaaatagccgactaaaatcatctttgttagcgtcggtagtttgactcgtaaaaaatcccgtaatcgtactggttaacaaaccgataaaaccgaccccagcgatcattaagaaggcggcgataaacttgccgacgttggtggcgggagaaatatcgccatatccaaccgtcgttgccgtggtaattgcccaccaaagcgcggatgggtacgggaccttctccactatagaatacatcaaggagctcaatactaagatgaacatactagcggtaaaaaggttcaaaaatcctgacgagtaaacaaagcggtgcacagttttggaaagtttaccatccaaaccaaatcgccagagtaaatggtggtgccgaattagtcgccaaacccggccaattcgaaaaatagcgaaggccggatgcagcggaattaacgataataaatcaaaagtgttatcaaagagaaatctttgccagtgcctactgctggctaggcgatagaaaaaatcgatcgtataaaggagcagtaaaacatttaataaatgggctaatggtggagcgcttaaacggatggcatggggatccaaaaacgagcccacgacgattaggaatgaaaagagggcgatgcccgcaattccaatgtcgtagcttagctgccaattgatttttgttttcgtcatgagtaaaatctcctaaattaatagaattattttaacgcatttctgaccggtgtaaatagtttagaaatgatatgataggactaattaatcctagaagaggtaaagcagatgaaaaaaatattagcattacacactggcggaacaatttcgatgtcggctagtaatgataaggtagagactaacgaagaaaatccgttattggatacccaatttattaacgaaaatattgatttggcaaacgaagtcgtattaaataagccttcggaacacattaccccagaagatatgttggtaattaaaaaacgggtcaaaaaggcaatcgacaatgatgaatgtgacggaatcgtaattacccacggtaccgatacgctcgaagaaacggcttatttccttgatcttacgattccaagcgtgattccaattgttttaacgggcgcaatgcgttcttctaacgagcttggttctgatggtgtttataatttccaaagtgcgattttaacggcggcttccgacgaagctacgggcaagggcgtgttagtagtcatgaatgatgaaattcacaccgcccggtttgttactaaaacccacacaactaacgtagatactttccggacgccaacgtttgggccgttaggaattgtatacaaacgggatattcgtttcttccaagctttaattagccaacaagtttgtgatattgacgagctagtttctggtgtttacttagttaaggcttacgcaggaattccaggagccatttttgagacgctagatcgcccagaaactaaggggatcgttattgaaggacttggtgcgggaaatttgccagttgaagtggtagaacccattcaaaaattgattaaaaagggaattccagtagtaatggtttcccgatgctacaacgggcttgctgaaccaatttacgattacgttggcggcggcattgacttagaacggatgggagtgatcttctgccagggacttaacggacaaaaggcgcggatcaaactccaagtggggttaagcaatcacatgaacggtaaagaaattgctcgctacatgcatgacgccgtttcttaacgaagcccgtgtataatagaactgtgggaaaacagaatgggaggaaagaaaatgacaagttcagttaaagaagatttttatgatgcagtcaacggagaatggctaaaaacggctaaaattccagacgaccattcctcgaccggaggttttatggacctcgttgacggagttgataaacagttaatgaaggattttgccgcaatgcggaatcacgaagttgaaccagatactcccgagttggccgaatttattaagttttatgaaatggcggcggactttcaacaacgggatgcggatggagtggctccgttattgccataccttgcacaaattgaaaaactgcaaaattgggatgacgtcaacgctaacctaaaggaattattctataacggggttgatttaccggtggatatcggaattgaacccgatttaaagggtgacggtgccgacaaacgtaacgttttgtgggctgggggcgttagcttgattttgccagataaaacttattacgacgccgataaccccaatggaccacaactaatgaaaatctttaccgaaatgatgaaccagctcttggtaaagattggtaagtcacctgaagaggcgcatgagattgttgaacaagccaaacggtttgacgctagcttagcaccataccgtaaaaactcggaagaacttagtgacgttgcgaaactctataatccaatggaatttacgcagtttgcggaccaagttcaaagtattgacgttaaaaaattagttcaagaattgttaggtacgcaaccagaacaaattattgttaccgaacctcgtttctatgaaaacctcaaccaagtggctaatgacgagacttttgccgactttaagagctgggcgtacgttaacatggtccgttcgttgacgggttaccttagcgaagagttccgacaaattggcggaatgtacggacgggcgttgtccggacagaaagtttccatgccgcaagaaaagagtgccttttatctagcacgccggacctttagccaagtggtaggcgaatactatggccaccgttacttcggggaagcagctaaaaaagacgttcacgaaatggtggttgccatgattaacgtttacgaaaagcgcttggcaaacaacgactggctaggggaagccaccaaacaaaaggcgattactaagttacgttctttgaagatcttggtgggttatccagatgaactgaaaccagtttataagaaattaaaaacgaaaactgcagctcagggtggcagtttagttgaaaacgtacaaaacttctcgcggatttttctggaagatcagttagcaaagtacggtaaaaaggttaaccgcagtgaatggcacatgagtgcggatacggtgaatgcttattactctccggaaggcaacttaatctgtttcccagcagcgattttgcaagcaccgttctacagcttgaaacaaactgctagccaaaattacggtggaattggtgcggtaatggctcacgaaatttcgcatgcctttgatcctaacggggccctctttgacgaatatggcaacatggacaactggtggacgcaagctgatttagatcacttccacaaactatccgaagccatggttcaagaatttgatggactgccatttgcgggcggcaaagttaacggtaagttggtggtaacggaaaacgttgctgatgatggcggacttagtgcagcattagaggcgactaaggataccgacgatgctaacttagaggaattctttacaaattgggcgcggatttggcgaactaaggcaactccagaacgggaacagctactgctagctattgacgttcacgccccatccaaactgcgggcaaacgttcaagtgcaaaatttccaagaattctacgacacctttgacgtagaacccggtgatggaatgtacatggctccagaaaaacgggtgcaaatctggtaatttcaggacttagtgcaggaaaactactgaataatttagttgattaaaaagccgtttggtgaagtgttaacttcgctaagcggctttttaagctagcggcttgggaaaactggcttgaatactgcattagtgggactaacgatagcaatattattggcgaatggttgggttagcttaggaaggccagcaaaaaactgcgactaagtaaaatttagctattttaaaactaaatgtttgattagatttctaattgtgttatcattgtgccacaaaataaaaaagcgtgggagacgagtaaattattttgcgctaacagtgagtcaagaaatagtggaaacttgattagtggcaatttagttgaataacactcctgtaagctccaggctgaaatgtagcgcgcacagattaggcttggacgttgccggtccgttaccaccggagcgtatgttagtacgtgttttgaggtgatccgttctgatgaatgggtaacttgggtggtaccgcgaaagtctttcgtccctagtattctaggggcggaaggctttttattttgtaattaatctcaaaaggagtgaggaagatgcatttaataattccagaaaaatatgaaccaaaattgtccgtacgcgaaactcaaagggcgattagatttatccgcgaaacctttcaagacgaatttggtaaggagatgaacttatcaagagtttcggcaccgatgtttgtcgaccactccacggggcttaatgatgatcttaacggaacggagagtccggtttcttttacaatacaagacttgccaaaccataaaattgaaattgttcattcactagccaaatggaaaagaatgactttatcgcgcaacgattttgacttacatgagggcatttataccaatatgaacgccattcgtaaagacgaagatttagataatttgcattccatctacgttgaccaatgggattgggaaaaaattattgccaaagaagaagggactacggcagttttaaaggagcacgtccgtaagatttttaaagtgattaagcatatggaacatgaagtttggtataaatatccccaggctgtttatcatttgcccgataaaatccattttgtcacgacgcaggagttggaagatcgttggcctgaaaaaagtcctgaagaacgggaaaaggcgattacgcaggagttaggatgcgtttttttgatgaaaatcggcggaccccttaagtctggaaaaagacatgatggacgggctcccgattatgacgattggaacttaaacggtgatattttgttttggtacgctcctttgcagtgtgttttggagctttctagtatgggaattagggttgacgaagacgcgctccgcagacaattaaaaatggctaacgccgaagaccgtagtcaattgccttttcataaggcgttgttgaacgaagaactaccgtacacaattggcggcggaatcggtcaatcgcgactatgtttgttgctgttggggaaggcgcacgttggcgaagtacaagccagcatttggccgcaagcaatggttgaacaatgcgaaaatgcgggaattcaacttttataaatgcggcgaagggcgtagctttattaaagtagcgaaacagagattataggctgcaaaacaagggcacttttccaagacttaaaacttggaagagtgctttttgtgtaggaattatttgctgaggggattagtaaagtgattagcaattggcacatttttggcaaaacacgaactttatctgcaattaattttatgctatatcgtactttgcttattttaaggattagagtagactatatcaacgtgcttttttgtttaaatcgaactaaaaggagaaagagttttgaagaatatcgctaagtattttcaatttgaacaattgaagacgaattttaaaaccgagattattgcgggaatcactacttacatctcgatggtctacattatgtttgttaatccaaacgttttaggcgcttcggggatggataagggagctatttttaccgccacggccttagctagtgcaattggatgtttcttaatgggaattttggcaaactatccgattgcctccgcaccggctctaggaatcaacgccttttttgcttactcagtagttattgggatgaaggtgccttggcaaaccgctttggctggagtattcgtggcttcactgattttcttgttaattacaatttttaaattacgggaattaattatcaacgccattccagccgatttaaaacatgccatttcagcggggatcgggatgttcgttgcctttctaggtttgagccaaggtggtctggtggttgctaatccagacaccatggttggcttagggtccttcaccacgccaaccacctggatcaccgtgtttggcttggtgattaccattatcctaatggttcgccgggtcccaggggcaattttcttcggaatggttctgaccacgctattcggcatggtgactggagtaattcacgcgccgacccacctgctagctgccgcaccaagtttaaagccaacttttctaaccgcggtttcacacgttggtgacattaacaccctccaactctgggtggtagtccttaccttcttattggtaactttctttgacacggcgggaactttagtaggactggctactcaggcaggattcatgaaggacaataaaatgccccgggtcggtaaggctttgatgtcggattcgaccgccatgctaacgggttcgttattaggaacttcgcccgtgggtgcgtttgtggaatcctcagctgggatcgcggtaggcagccggtcaggtttcacggtggtaattaccggaattatgttcatcttgggaatcttcttctccccgttgctaacggtggtcacttcccaagtaacggcgccggcgctcattattgttggagttttgatggcacagcagacacgtgaaattaactgggatcgtctagaaattgccattcctgcatttttaattattattggaatgccgttgacgtacagtatttcagatgggatggccttagggattatcagttacccaattgccatgattgctgctaagcgcggtaaagaagtgcatccgttgatgtacggattgttcttcgtttttattgggttcatcgcaattcttaacgtttaaaaaaattaattaatcagttttggaaagtggaacaaactgacttttggcacacgttttggtgctattgaagtcaaaaaaccaaaataaaaacgattcatgaggaagcttcacctcatggatcgttttttgtttagcgacttttgtcccactctccttttttaatcaaacgacaaaacgtttttgactaacataagttaaaaagtcataattaataacggattattgaaaaaattttggtagattagaatccggtattggagattcgtcaatagtgctgagcactcggttttattgaaaattaatttttgaggtggcaaatggcaaaacagaagtattacgtagtaaaaattggtaaacagcccggaatttaccggacttgggccgaaactgaagcgcaggttaagggattttctggggcaagctataaaagctttggaacgttagaagaagctgaacagtggcaagctggtaaggaagttacggaggctaaatcagctaagaaagctaccccgcaaaagcagccgctaatcccccaaaaagatcctcaggttccaaccgatcggatccttttatatacggacggcggatcccgcaatacgggtaccgtaaaaggtggtcacgtgcggcaagcggatttagcagcgtgggcgtacttgttgaaaaaagatgaccaagaatattctcaatcgggtggtgagtttggtgccactaataaccgaatggagttaacggccctttggcgcgggttggaaacggcgttggctaaagtcggtaaggacgcaccaatcactgtgatttctgattctaagtatattttaaacgccatcactaagaaatggcttgcgggatggcaacgccgcggctggaaaaaatccaccggcgacccggtagctaaccaggaactgtggcaacagattgctaagctgctaccccaattcactgatttacaatttttatggacaaaaggtcacgccactaatcaaggaaatatttttgttgaccataaattaaataaaatgatggattatatggaagaaaagggaatggtccccgtagatgataagcttccaaaataattgcaattaatttaaaaatgtcccgtcgttgttagacgttaatctaacggcgacggggcactttggtaattagggtgtttagaatttatcagtgctagataactggtagtgctggatggttccggtcgttttaacaagggaaaaaccagcttctttcaacacttgaatttgcgagacgttttcctgatcaatcgccccgttaatttgcgatagttctaattcttgaaatgcaaaaataattagccgttttaaaacctctgtcattgcggcaacctgcaacgtttcatcgggcagggtgaattggatggtggcttgttgaggatggtcgacaaactcagttaatcccgcgatgccaataaattgttggtcggcgcggcgggtgattccccaaaccaaggcgcggttattcattacttgccgcattacttggttaacgtaggcaaccgtgtcggtgagttcctgatcggccgagcggtgctcttgctgtgcaatttggggatggcttcggagggcaaaaatgtcctttaccttagttttggtaagccaatccagactgtattggttagtcaaaattgggtgataaaattcaaattttttcatggtaccctcctgcaaaatagtacgaaagaacccggtagtttttagcgattagtaaataattgctagaagttacgcgggttcttttttgaattatgaaacgggccgccgagcttacttggttttcataaaatcggtgatgcgctttaagtcatcgtcggtcggcgtgtacgagttttccttgattcggtgaatcttttctacggatagatgtgttccaaaggcaacgtcagcatccgtaaggttatttttcttttggaaattgataattttttccgcaaattctgttacgccattcataaagaatccctccataaagtttccatctatgtatgataaatcctatcataattgccgggttaaacctagcaaactaaatcaatagctgatgatttttatcaagactaactttattataacgctcttcgccataaatgcttagaggagttgccggtattcgttttcgaagaaactatttttggcgtataccatggcaatcggccgactaatatcaagtcctttaatgggcagcgtcactagggattgatctgcaagttgaggattaactaaggaacggtacataaagctcacgcccaagctttgaagcaagttaacgatcccaccggaacttccaaattcaattacttgagcgaagtcgtcttttttgacgttaaatgcactcgcccaatcttcgaaaactttccgggttcctgaaccgttttcccgaagcaatagcggttcgtccaataaatcggttagcgtaagcgaagaacgttgggcgagtggcgaggaagcacgggtaaccgccacaaagtcttcggtagtaatggtttgactgctgtataaggacttgtcaaagttaccttccaaaattccgatatttagctttccggtatcgatctgagacaaaatggtacgggtattagcaaccgtgcactgaatatgggtgtagcgatcgtgccactttcgcaacagttgcggagccataaaaatacttactgaatgagttactcccactcgaagcgtggttgctttggcaggatgttgcagccgttgtaccagttggttttcttggtgttgggtagtttcgatgaatcgcgctagagcttgtccggcaggggtgatgctcaaatgcgggtggcggtattccaccaattttagctggagttcgttttctaaactcttaacctgttgggaaactgcaggctgggtaataaataattccttagcggttttcgtgtaggatttatttttcgacaataaagcaaacgtggcgtagcggttatcaatcatcgtaattctccctataagtaatatctatagactgattatatattataattatattttattcactaactttgataggataattaatgtgctagaaaacgagtaaccccaaaagtattcgctaggggtttacaaaataaacaaagagaaaaggagaattattatggcaaagttggtgaaagaaaaaagcttttggacagctattggagtaacgttactctgcgcgttagccggtagcttgttggcccaattaccatattttagtttaattggcgccttagtaatttcattagttttaggaatgttagtacagtttagtccacgggtcgtggaaaaatccaaaaaaggtaccggatttatttctaacaaatttttacgtttaggaatcatccttttgggatttaagttgaacttaattgatttggcgcatgcgggagtaaagacgattttgttggcggttttaatagttggtctgacaattttagtggtttacaacttagcgcgaaaatttaacgtggaatctaatttagcaatgctcgtggcaagtgggaccggaatttgcggggcagccgcagtaatgggaatctccccacaaatccaggtgccggctgaccaagaggaacaaaagcgggaagacgaagttatggcaattgccgtggtggcgattttaggaacggtctttacgtttatcgaaattggtttgaaatcatggttgcatttaacgccgacccaatttggggtcgttgctggcgggtcactccatgaaattgcccacgcggtggcaaccggtggtgcgggtggtccggttagtttggatacggccatcattaccaagctttcccgggtacttttgttggctccggtagccttgattatcggtttctggcaccggcggcggaatgaagttaacgttgctaatcaaacaaagggcaagctcccaattccttggttcatgggcggctttatccttgctagtgttgtcggaactttcttaccattaggtgcaggcgttttggcaggattagttaaactggcctacattttcttgggcatggcaatggctgctttaggtatgtcagtaaacttcctggtaatcttaaaacgcggtaagggaccgtttgcggcagcgacgatcggctcggtattgttattaattttcgtaattatggcaagcaagtggttcttctagaatttaaagacatcagttattaaaaaatgagcgtcggacaaaagccaggaagtttgtgagcattaactgaaaatcgacttatgcttggattgggtataatagtcatttttggttaagcgggaaaatggcttttgacacacatttggttttattaaggtccacgcaaaaaatgtttttcgagaattttccattcttgaaaaacattttttattttcttctcagtcccgacctttgttaggaatgttttttgcagctgagtccaaacgttcttttggccccaactttttccggttaatcaaataagggactcaatcgccaatcccacgattaagtcccttattccattaatcctaggtgcttttctgcagctgagctaaaacgtgttccagcccccagggtttttgcggttaaccaaattttggagtggttctctgcagctgaggccaaaagcactctacaccattatccccatcatcaccggcaccattattagtgataataacgtggattccgtcaccataattgatgcaaaatcggcatccgcatcgtatagcttggcgactaccggcgcattcgtcattaccggcatgcacgattgtaaaatgaagacctgcttcatgattaggggcatggagcttggcattactaacagagccattaagcttggcgcaaaaacaaaccggccaagtaaaactcccacattgtctttttgaaaacgcatattgcgcaaacctgcatcgtaaacggaaaccccaataaacagcatggacaatgggatggtcagtccccctaagtaagtgaagctagacgataagaaactaggtaggtgaatgtttaggacgatcaggacgattccaatcataaaccctaaaagcggggctgagaagatcttttgcaaggtgctttttagactgattttggtttggcgttgttggtcacgttggatgaagtaaacccctaacgtccaaaaaatggtcgtattagccatgtaataaaccaacacgtacggcaagctgcgttctccgaagattgctaggttaatgggcaacccgacaaaaacggtgttggagttaaaaaacatggaagtaaacaagccttgatggcgcgggtcaacgtgaattaagcgcacaattaaccaagcaagccccattaaaatgaacattgataaaaccgggtaccaaaggttgggcagtaacttgaaaagttcagctttagtaaaatctttggtaattgaagtgatcatgtaaggcggcagggccacttgggtaacaagcttagcaagcaactttttagaatcctcgttaaaccagtgtcgagaggctaaatagtaccccacggcaaccataataatgattaccagtaccccttgaatactttgtaataaaatttcgctcacccctaatttgttttctagtctattttagcgcaatatccatggtaaaattgaatttaattagtaattaaatgggggaaaagcgcatggcaattattcaagtaccacacgatttgaccgaagtaagggttaaaaaagaacaattaaaagaacagggtcaaacggttgctgaagaacaattaattgaacaagcaatccaggataatgcccaacacttattagacgacattttggacgggcactactttacttgtaaattagaaaatgacgagttggtagtctatgacgtgattaacgcgcccactggtaaagttgcacctcgcggaactagctttactgaggattttacacaagatgcggatagtctctgggactacttggataaacagctaagtaaaatcgctggcggacgttagtaactcaacaaggaggatgttatgacggagattcgattaattgcaagtgacattgacggaacttttttaaatgaccaacgggagtttgaccggtcacgttttcaggcccaactagacgaacttagtcgccgacaaattaaatttgtggttgctagtggaaatcaactggctcactgccaagaagtttttgcaggaattgaaggcgacttgacttttgttgctgaagacggcgccctgaccgttgagcaagggaaagttttggatgaaaatccccttaaaccggccttactgcgtgatgcgttggattatttaatgagcactccggagtttgccgaagcaaaactaattttgtcgacccgtcaacaagcgttcaccaacatggtgcctagtgacgccgattggaaagacagtgcatatttttatcaacaccttacgccggtagcaaaactaacggcggtaaacgagccgatttacaagattgacattcattggagtgggctaacggatgtgcgcccccaagctgagcagttacaaaacgcgctgggagatgaccttggttgcgtgatgagtggactggggggcatggacgtcaccatgccacacgtgactaaggcttatggactgacccaattgcagaacttgtggcagatttccatggacgagaccatggccttcggcgacacgcaaaatgacgaagccatgttacagcacgcgcgactaggttatgcaatgaaaaacgcggaaccagaagctaaaaaagcaacgaagctaatcacaaaattggacaacaaccacagcggcgttttagacatgattgagcggttgttggccggggagattaagtaggtaactacgcggatcctttaaaatacaagtgaaatggaagctgagaaggaactgaaattattttggtatattgactttaatagagccacacccgcgccaaaattcagtctgtttcgtttaaccccaaaacgactattatgctaaatacaaacacgatggtcgttttttagttaatactcataaactacccgacttttgtcccaagccctattttttaccatatcgtggcttgacatttaatttcaggggtgtatcattggtaaaaattaatcgagtcgctttaagttgatcccgagaggtcaacaagctaacggagtcgccatcagtaggtggaatggacgcggttagcgccggccattttacttactggtggtttttttgtacccaaaatagcgatttcgaaatccaaataaaggggttcaaacatgacggaaacacaaactcaagcagcaattattcagcaattactggaattgcaggcgattcaggtaaagcctgacgcaccgtttacgtacgccagtggaatcaagtcgccaatctataccgacttgcgtatgacaattagcaaacccgcgttacgtaaacaaattgccacagggctcagcgaactaattcgacaattttatccgacggcaacggtgatcggcggggtggcaacggctgggattccgcacgcagcgtgggttgccgaggaactcgaattaccattgatctacgtccgttctaaacccaaggatcacggagcgggtaagcagattgaggggactttacaagccgctgatcaggtggtgttgattgacgatttgatttcaacgggtggcagcgtgcttaaggctggcaaggcggttcgccaaacccccgctcaactgctgggggtcgcgagtatctttagttaccagcttccggacgcacgccaaaactttgcggctgaggaaacccagttacatggtctgatcgattatcaccaattaattgatcatttagctacgcaacaacaactaactcctgaccagctagattcggcccgcacctggcatcaggatccttggcaatggggcgcaactacaacaattaaataagatttagtttcaattaaatcggtttcccgagaggaaccaattgaatcggcttttttaggctaccttccaagcaaattcaattggcaggtagccttctttgataacttaaggaggaaaaaataatgaatatgcatgacttgactacggtagaaaactttaacgaagcggacgtattacacaaaattaaattagcagaagaattcaagaagggtaagaaggtgcaattaaagcgcccggtttacgcgatgaacctcttcttcgaaaatagtacccggacccacaccagctttgaaatggctgaacaacgcttaggtatgaaaatgttggaatttgaggcacaaactagttcggtttccaaaggtgaaacactgttggatacggtgaaaaccattgacgcgattcgaacggacgtggcggtaattcggcatccccaaaacgattactatgagccaattttggacgagaatttagacatcagcatcgtcaacgcgggcgacggtagcggccaacacccatctcaatcgttactagacataatgacgatttacgaagaattcggtcgttttgcgggcttgaaggtggccattaccggcgatatcgcccattcccgggtcgcgcgttctaacgcaatgctactaaataagctgggcgcacaagtctactttgcgggtcctgaagaatggatggctgaagacctagctgactacggtacttatcggccgattgacgaactggttgaccaagtcgacgtcatgatgttgctgcgaattcaaaaagaacggatccaggatcgcgataatttacggatggaagttcaggattacttgaccaactacggtttgactaagcaacgggcagaacggatgcaaccacacgcgattatcatgcaccccgctccggttaaccgcggaattgaaattgaaagcaaactggtggaatgccaacgttcacggatctttaaacaaatgaccaacgggatgtacatgcggatggcaattttgaccgacgtgctaaacgcgaaaaacttggtgatgggggcgtaaataaatgcgaaccttgattaaaaacggccgggtagtctctaacggccatctacaaaaggcggacgtcctagtggaagatcaacaaattagcgcaattgctccccaacttgcggagacgacggttgctgaacgggtcattgatgcccaaaatcaactggtacttccgggattggtagacgtgcacgttcatttccgggaccccggattaaccgaaaaagaagacgtaactaccggtagccaagcggcgttacggggcggatacaccaccgtgctgacgatgcccaacgtaaatccggttcccgatgacccgacccggttagctaaaatgattgcgcataaccaacaagctggtcgggtgcacattgggcaatacgtagcggtaactaagaaccggaccagcgatcagttggtagactttgcagctcttaaagaagcgggggcggtggccttcagtaacgatggcaacggggtccaaagcgcacaaacgatgtaccgggccatgcaagctttacaaaaaattgatttgccgcttgcggcccacgtggaagacgaatcgcttatgcagcacggggtgatgaatgccggggcgcgtgcccaagaactagggttacccggcattgatgagctggcagaaacggcacaattagcccgggatttagaaatcgcgcgaaaaacgggcgtacactaccacgtttgccacgtttctacggcacggagcgtggagctgattcggcgagcccaacgtgacggagtgtgggtgactgccgaagtcgccccacaccacctcttcttggatgaacagatgatcactaaggacaaccccatgttaaagatgaaccccccgttgcgccggttagcggaccgccaagcgttacttgcgggattgctggacggcacgattagcatggtggctaccgaccacgctccctatacggacgcggataaggcgggttcgataaaaacggcggcctttggaattaccggattggaaaccgcctttgccttgctttacaccaagctagttaaatcgggaatttgttcggtcgttcaattggtcaactggatgagtaccaaccctgcgcaagcctttcgattaggggacgcaggtaatttaacggtaggcgcggtggcggatttaacgattatggacgtggatcacgaatatgaaattgatgctgcggcgatggcatcgaaggggcacaacagtccattgattggtcaacgagtttatggtcaaccccaactcacgatggttgcgggacaaatcaagtttgaacgaaggggcattttaaaatgaagcgttatttagttttagaagacggcacggtttatccgggcacggcaatcggcgccaatcaggaacgcatcggcgaactggtttttaataccggaatgagcggataccaagagtccttaaccgaccaatcctataacggagaaattttaatgtttacgtacccgttgattggcaattacggaattaaccgcgacgattgggaatcgattcgttctagttgcgcgggagtggtggttcacgaagttgcgcgacgggctagtcactggcaaatgaaaatgacttttgaggagtttttaattcaacaggaactccctggaatcagcggaattgatacccgggcggtaacccggcacattcgcgaacacggggcgatgaaggcggcgttagtcaacgaagtccgcgatggcttggtggaacaaattcagcaattcaaatcgaacgcacacccaatcgaacaaagcgcgacgccccggccgtaccctaatccagcaacgggtcggaaggtggtcgtggtggactttggcctcaagtattccatcttaagggaacttgcgcggcggaattgcaatgtaatggtgctgccctacgatgcggacgcccaaacggtcttagcaaataatccggacgggggtgcttttaagcaacggaccgggggaccccgaagcagttccagacggcgtgttacaaatgattcgcacggtggaaaaacaagtgcccgtgtttggcatctgtatggggcaccagctctttgcccgggcgaacggcgcccggacgatgaaattaaagtttggtcatcggggatttaaccatccggtgcgcaatttagctactgggcgaatcgacttaacttcgcaaaaccacggctacgcggtggaccgcgcttcggttgccgcgaccgatttgacgattacccacgaagaaattaacgatgaatcggtggaaggtttacgtcacgaaaagtacccggctttttcagtacaatttcacccagacgcggcacctgggccacacgatgcggtcggtcttttcgaccaatttatgcggttaattgaccaacggaaaaaaataatggaggtgcgctaatcatgcctaagcgaacggatttaaataaaattttggtgattggatccgggccgatcattattggtcaggcggccgaatttgattactctggtacccaagcgtgcctgtcgttaaaagaactcggctaccaaacggtgttggtcaactcaaatccagcgaccatcatgaccgatacggacgtggcggataaggtctatattgaaccactcacccggcaattcgtatcccaaatcattcgcaaagagcgtccggatgccattttgccaactcttggaggtcagcaagggcttaacatggcgatggaattagccgaatcaggaattttaaaggaactaaatattgaactattaggaactaaattggatgcaatcgaccaagcagaagaccgggaacggttccgatcgttaatgaaggaacttggtgaaccagttcctgactccgcaattgcgaccacggttgccgaagcggtcgacttcgctaagcaaagtggcttccccgtaattgtccggcctgcgtttacaatgggcggtaccggcggcggaatcgctaatgacgaaacggaacttcggaaaattgccgccaacggactcaccctttcgccagtgacccaagtgttgatcgaacaaagcattgccggaatgaaggaaattgagtttgaagtaatgcgggaccacgccgataacgcgattgtagtctgcaacatggaaaactttgacccggtagggattcataccggagattcaattgtttacgcaccggttcaaaccttaagcgaccgggaagttcaagagttgcgggacgcggcgttgcgaattattcgggcgctaaaaattgaaggaggttgcaacgttcagtttgcccttgacccagtccagaatcggtactacgtgattgaagtcaatccgcgggtaagtcggtcaagcgccctagcttctaaggcaaccggctatccgattgccaaggtggcggcgaaaatagccattggattacaactcgacgaaattttgaatccggtgaccggctcgacttacgcggaatttgaaccagcgctagattacgtggtttgcaaaattccccggtggccgttcgataaatttgccaacgccgaccgccgtttgggtacccaaatgaaggcaacttgagaagtaatggcggttggtcgcaccgttgaggaagccacccaaaaggcggtgcgctccctcgacattgacgtggcggagctccatgatgaacgcttagctaacttaagtgacacagagctacttgctggaattaaagtagcccgagacgaccgactattctacctttacgaagcgttgcgccgcggcgaatcgttgactaaattagcgcaattaactaagattagcgtttattttttggataaattactacatatttatgaaattgaaacggcgctgcaggaccatccctttgcaaccgaatggctaaccgatgctaaacattacggttttgcggatactacgattgcccggctttggcaaaccactgcggaccgagtgcgcgaatttcggcagcaaactggaattcaaccagtatacaagatgattgatacttgcgcaggggagtttgcttccagtacgccgtattattacagcacctacgaatttgaaaacgaaagccaagtttcagaaaagccctccatcctagtgttggggtcgggtccgattcggattgggcagggggttgaatttgactacgccacggtccactcgattcaagcaattcgtcaaatgggttacgaagccatcgtggtaaataacaacccggaaaccgtttcgaccgacttttcaatgtctgacaaactatattttgagccgttaactgttgaagaggtgcttaacgtaatcgagttagagcaacctaagggcgtaatcgtccaatttggcggccaaaccgcgattaatttagccgaagccttagcggaccacggagttcccgttttaggcaccgcggtggaagacgtaaaccgtgccgaagatcgggacgagtttaatcagttaatcacggaaaaccagttccggcaacccgaaggacgaaccgctaccacggttccagcggcaattacggcggctaatcaaatcggctatccggtggtcgttcgtccaagttacgttttagggggccgggcgatggaaattgtccacaaccaggctgaattggaaaactacatgcacaccgcggtccaggtttcccaccagcatccggttttgatcgaccagtacctagtggggacggaatgtgaagttgacgtggtcagcgacggacatgacgtagtgatcccgggcattatggaacatattgaacgttcgggtgtgcattcgggagattcaatggcggtttatccggctcaaaccctttcaacaaccgtgcagaaccaaattgtggaaatcgcgactaaattggcccgttgtctacggtgcgttgggctaatgaacgttcaatttatcgtccacgacgaacaggtttacgtgattgaagttaacccacgcgctagtcggacgattccattgattagcaaggtcacggatttaccactggctcggattgcaacgaaggccatccttggccaaagtattcgggaacaagggctaactccggggcttcaccgaccgggtaagttaattcacgtgaaggcgccggtcttctccttcaccaaactaaacgatgtggatagtttgttaggaccagaaatgaaatccactggcgaagtgatgggaagcgaccgtactttagctaaggcactgtataaagcgttggagggtgcaaaacttcatttaccagaccacggcaaagttttgttaacggtccgcaacacggataaggaagaagtggttggtttagctaaacgcttctgggatctgggttatcaactagtggctactgaagggaccgcggcagtcttgaaacaaaacggtttacctgtggaaacggtggaaaaactgacggaatcgacacaaattttaaacgaaatcaaacaacatgaaattagaacggtgattaacaccattgctgacgatccggatagcgccaacgacggaattaaaattcgacaaaccgcgctaacctacggagtgccattgtttaccgccttggatacggtggatgccattttacaagtgttagaagcccaagcctttactacggttcacctataaggaggaagattatgcaacgcttagaaacggaaattgcgggagtaacgttaaaaaatccgattatgaatgcgagtggtactgccgcgtatggtcagtccctggcggagaaaatggatttaaacgaattgggggccttagtgattaaatcgaccacccaaaccccccgagcgggcaatccatggcccacaacggcggaaaccagcgcgggctggctgaacgcggttgggttaaagaatccggggatcgaccacgtattaagtgaagaacttccctggttagccaataattttccaacactaccgattgtggggagcgtcgcgggaagtactttcgaagagtacgtgacggtcgcacaccgtatggctagcgcaccgaacgttaaattaattgaagtaaacgtctcctgcccgaacgtaaaggaaggtggaatcgcctttggaacggaaccgcaaatggtgcgagaactaacccaagcaattaaggcccaggtggactgtccggtgttagttaaactaactcctgcggtgaccgccatcgaacccctcgcacttgctgccgaagcgggcggagcggatggactggtcatgattaatacgttgatgggaatggagattgatctacacacccgcaaaccgcacttatcaaacggtactggggggctttctggcaaggcgattcatcccctagccgtgcgaatggttcaccaagcacgccaagtaaccgatttaccaattattggcgtggggggcgtttttactcccgcagatgcgttagaattgatggtagcaggagcccaagcaattcaaattggatccgcaagctacggcaatccgcaggcgtgtcacgacgtcatcacggaattacctgccgcaatggatcgatacgggtttgaacgggttgcagattttaaggtgaaaaattaacggaggcggagtaatgatacaatcccaatcaattgaatcgatagccgctgaaaagcaatttgataccgtgattgtaggtgctggcagcgctggtttagtaagtgcgctcgcgttggccgaagcgggaaaacgggtaattgttttagaaaaaatggctaagcctggagggaattctattcgggcttcttcagggatgaacgctgctaagacggttgttcaggagcacgcggggattaaggatacttacgaatccttttttgaagatacctaccggggcggtgggcggaaaaatgacgtggacatgttacgctactttactagtcacgcagctgaagcagtggactggctgaaagaacatgggattgttttagacgatttgaccttaactggtgggatgtcagttaaacgagcccaccgaccaagtagcgctccggcaattgggggatacttgattcatcacttagtagatgatttgacccaaaaacaagtcccaatcctttgtcaaactaaggtagtgaatattatgcgaatggaatctggagattttcagttaattgctgaaaaccaagctggtgaccgacaaacgttacggagtgcgacggtaattttggcaaccggaggcttttcggctagccaagatttaattggtcattaccgacctgatttgctgcattaccgcactacgaaccaaccgggagcgaccggtgatggcctgcggttagcacaacaattaggggcccaattaatcgatatggcggaagttcaagtgcatcccaccgtctatcaagattcagcaagaacctttttaattggcgaaacggttcgtggcgagggcgcgattctcgttaatcatcaaggaagcaggttcgttaatgaactggccactcgcaaagaagtcacggcggcgattaacgcacaaaatccggccaacgcttttctaatttttaatcaatcgttgattaaccgggtggttgccgtccaattttacgaccaaattggtttggtcacccatggcgcaaaccttgcagaattagccaatcaattgaaaattccccaagctgcattgaatactacgatggcaacttggcaaacggtggttcaccaacagcatgatgcagaatttggccgcaccaccggcttggtagatgactttgcaaccggaccttttgcagcaattccggtagctccagctgtgcactatacaatgggcggcgtaaaagttaacgtagaaacccaagttttagatgaccaacaacagcccatcgcaaggctttatgcggctggagaaaccgtgggcggcttacatggcaataaccggctcgggggtaactcgattgcggaaacggtagtctttggactagcggccgctcgtcagattgaaaattaccaagcttaattaaaaaatcgactgttatacctaaatttggtatgacagtcgatttttggttagtacttgcaaactatctgacttttgtcccgtttgctttttcttaactatgtttaattagcaaattcggttgcctaattcttgcatatctttcttaagttgcttaccgtctccgtcgtcttggggaacaaagttcgttaccgtaacggcgttgtcaataattccactattgtcgcgaagtgaaagcagccccatcttgtaatcaagggtaaggccttcgcctaaataagtgggctcgtcatgtccggtagtaagttgcaacccggcattgttttcaactggttcagcatagtcagcgtcttcgttgtccgcaaccactagttggaacttgttgccaattgaacacgaaccgcctaacttagagaatttacttgagccgtcgtctaacgccaagaagacgtggcgttgaccaatgtttttagtatttaaatattcttgtgctgattgagtaatgttgatttccatagtgtggcctcccaataaaattgactgcatgtctcttacctacgagctaatcctagcgcaagaaggagcggaagttaaaaattatgcttgtgattatgcttctaaagtttttcgccgggtaatcaaccaccgccgaattacaataatgtcggcaattgcgagtaatcccgcagaaatcgcgaatgaaaaatgcattccgaaaatgaacagttggtcatttccgtgtggataggtggttaagctagtgtgggccttggcactcatcaacaggaacaatgcggatgtggatattgttacccctaaaatcattccaaggttccgcgctagggcgttgacgctaccagctattcccaagcggttatgcggcaccgccgacattacggaagcgttgttaggcgattgaaataatccggtccccattccagtaacgatggatgcaaaaatgaagaaccagtacggcgtttgcaagttgaatcccataattaaaaattgagaaatcaacagcagcgttacgccgattacggtgattttagcgccaccaaatttatcagataaaaagcctcctaccggtccgaaaatcaccatagtcaacggaatgatcgacaagaagggtcccggccactcccgaagacaaaccgcgggcgttaactagataataaggcattaaaacgttgtagaagaaaccattgatgaacacgaggagtgcggcaatgagccctaacgtgaagtcagcgtattgaaaaatcgataagtccaacagcggatggcgccggtgattttcggtatgaataaacaaaataaatgaaattatggcaattaataaggctccaagaattaacggatttagataaccccgttcttgtccgcgaagaattgcgaagaaaaaggtgataatgcatattgcaaattcaattgctccagtccagtcaattggggcgttagctgcgaggggctggtcgtgaggcaaactctttacgccaattaaaacggctataattccaatgggaacgttaatccagaaaatgtaattccaagtcaaataatttaagataagtcccccaatagcgggtccggcaacggcgcccaaagcaacgaaggttccgattacccccattgcacgcccacgttgttcaatgggaaaggtactcgtggtaatcccaaagctgttagacatggtcatcgcggctccgatagcctggacggcacgcgcaaatagtaaaaatgccagacctagattgattccggcaaggagggaccctaagataaatatggccgtcccaatccgaaatacctttgatttaccaattacatctcccaaacgaccaaaaaacattaagagggcgctgatgacgattaagtaaatggaaacaacccattcaatgcgacttaaactgatgttcatctcctttgacatgattggcatggcaatgttgacaatcgagccatcaagggtggacataaaggtaaaaatacccaacgcaattaagatcagcgttttatttgtttttgaaggcgcttgtgactgcttcattcaattcttcctcctgtaaataatttgtacaactacatattttcccgttatcatgggaaatgtcaatcttttcgagctataaactatctaggctgttaaaaaaacgattttcccgataaaatataggaaaaacatggaaagcaggtaaattaatgtcaccaaaaaaaattgaccatattgcgattatttgtactgattacgaagctgcgcggaatttttacgtggagcagttgggaatgcaagtagtgcaagaaaccaaacgaagcgataagcaagacgttaagttagatctgcgttttggggatttaatggtcgagttattcattaagccaacggcgcctaaacgcctgacgtatcctgaagcagcaggattgcaggattacgccacctatgctttaaaacggaggatattgctgccgacgttgccgagttaaaggcaaaggggattcgagtggaacctatccgagaagatgagctcaatcagcgtaaaatgacctttttctttgatccggacggtttgccaattgagttacacgaataaacttctccacagtgttagtggaataaaaatgagagtgggacaaaagtcgggtagtttacgagcattaactgaaaattgcccatgatgcctgaattgggcatgatgggcaatttttgattaagcgaaaccaactgacttttggtacacgtttgggctttgttgaagtcaaaacaccaaaataactttttaaggaccttttcatccttgaaaagttattttttcccagtctctttttttgcttggtgtttaaggatgcggagaattacgcaataaagtcaaaacgtgcacccagccccagtttcttccggctaaccaaatatcggccttaatcgctaaggtgattaagaccgatattctgccgttctagagttttactgcgataaagtcaaaacgtgttccagccctcaaagttctgcggttaataaaattttagccttaatcgctaaccctgcaattaaggctaaaatctaattaatcttcaatactattgcagcttagttgaaatgtgcacccagccccagtttcttccggctaaccaaatatcggccttaatcgctaaagtgattaagaccgatattctgccgttctagagttttactgcgataaagtcaaaacgtgttccagccctcaaagtcctgcggttaataaaattttagccttaatcgctaactccgcaattaaggctaaaatctaattaatcctcaaactctgcccgagggcttccacactctaaatttttctccgcacatcatacgacgcattatttttatcttgattaggttggcgatcccttacgtaaaaaatggcgtattcctcatttttatccttattattaacgactactagttcatcatctagccgctgtttttgcttatagaggtgtcccttacgcaccgcttcgttatagtcgtgaaaattaccgattgaatcaccgggattaaagaaaattgtttcactcatggtatccacctcctacgattaccctaactataattgaaaatgtatacgttttcaacaattacgccataatcccaaattagacgggttggcgtagcttaaagttggacaattaaaaccaaatttggtatttttttgtgttttatcggcttatctattgcattttggtttagaccattttataattggactataccaaaaagaaaaaaggagcgctgactatgaaggtaattatcgtaaaaaatgatgttgaaggcggaaaagaaggttacaaagtttttgctgacgcaaagaagaacggagcaaaaacgttcggtttagctaccggaagtactccaattaccacttatcaagaaattattaaaagtgatttagatttctcagactcaatttcaattaacttggacgaatacgtgggacttcctgccgatagcgatcaaagctacaactacttcatgcacaagaacttatttgatgcaaagccattcaagcactcatatttaccaaatggtcgcgcaaaagatattgaagcagaagcaaaacattatgatgagattattgcggaaaacccaattgatttacaaatcttaggaattggacgtaacggacacattggtttcaacgaaccaggaactcctgcagatagcactactcataaggtagcattaactcaatcaactattgatgctaacgctcgtttctttgaacatgaagaagacgttccgcgttttgcgatttcaatgggattggcttcaattatgcaaagcaagcacattttgatggaagcatacggtgaagacaaggctgatgcaattaagggaatgattgaaggaccagtaaccactgatttaccagcaagcttactgcaaaaccatgataatgttaccgtaatcgttgatgaagcagctgcaagcaaattgagtggtaagtactaaaaaacgaacggaagttaccgaaaactttgtgaaggtaaaaactaaaaagggtacttttttagacgagtttgccgaagaaatgtaaaatgttaactctaatcaggagattaaggagctttttccttaatctcctttttatttcccgctgttttcgaacaaaaaagcctcaaaggattgaaaacgtttcctatttggaataagatgtttttataggtattgggataaatagtccccaaacgtcactaattttgttatttttaatataaagaatttgccgtaaagtggggtagcacgccgatttaatagttattagttatctaaacaataactttaatgggaaaatacgggctgattctgataaaataagtcttattgtaagggagcaatcacaaagtggaaaaaataattgcaatcaatgctggtagttcaacattgaagtttaagcttttcgaaatgcctgaagaaaaggtgatttcatctggagcggtagatcgaatcggtattccgggttctaattttacaatcaagacggccgatggacacaaaactaaaattgaacaaccaattaagaatcatgaagaagccgttgacttattgttacaacaacttctaaagctagacatcattaaggattaccacgaaattaccggagtgggtcatcgagtggttgcgggaggagaaattttccaagattccgcgttaattaatgatcaagttttaaaagatatcgaggatctaaaggaatatgcgccattgcataatccagctaatgctacgggaattcgcgcattcaagaaaattttgccagacattaccagtgtggcagtttttgacacgtctttccacggtacgttacccgagaaaaattatctatatagtattccttacgaatactatgaaaaatacggggctcgcaaatatggggcacatggaacgagccaccggtacgttgcgggacaagcagccaaattaatgcaaaagccattggaagacttgaaattaatcacgttgcacttaggtgcgggaagttcaattacggcgattaaggatggaaagtcttttgatacgtcgatgggcttcactccattagctgggatcacgatggctacccgttcgggagatatcgacgtttctttggtagtttatttaatggaaaaacttaacattaaggatccacgaaagatgctagaaatcctcaacgagaagtcaggattattaggtttgtcacaattatcgcctgatttacgcgatattttagatgctgcggatgatggtaatcaccgtgctgaagtggcggttgacattttggttaacgacattgttaagtacattgggtcatacgcaacggaaatgggcggccttgatgggattgtctttactgccggaattggtgaaaacagtgtgccaattcggcaaaaagtcgtgaaccggttaggtatttttaacgccaaactagatgatgagcttaatcaacaatgtggcgaacgttttatcaaccaagcagattcagcaattaaaatcatggtaatcccgaccaatgaagaattagcgattgcacgtgaagtggaacgctttaagaagatggaggattaagttgtgaaattatttgaaacatttaaaaataaagttaaagaacaaaaacggacgctagttttgcccgaaggtgaagaccaacgggtgcttggtgcggcagttcgtttagctaatgaagaattggctaaagtaatcgtattaggctcaaaagaaaacatccaagctttagcccaaaaagataatcttgacttagctaacctgcaaattattgatcctgccgaatatcctgctgatgaaaagcaagtaatggtagataaactagttgaacgtcggaagggtaaaaatacgccggaacaagcggttaaaatgctagaagacgttaattactttggtaccatgttggtttaccttggtaaggcagacgcaatggtttctggggcagctcacgcaactagtgatacggtacgaccagcgttgcaaattatcaaaactaaaccgggcatgcggcggatcagtggagccttcctcatgcaacgtggtgatgaacgctacgtctttggggactctgcgattaacatcgatccggatgcggacacattggcagaaattgccattcaaagtgcggaaaccgcacgttcgattggaattgaccctaaggttgctttactaagcttttccacaaagggttcggccgctggtgaaatggttgataaggttgtggaagcaaccaagttggctaaggaacgcgatcctagaaccccaattgacggggagctccaatttgacgcagctttcgttccggaagtaggaaccacgaaggcaccagaatccgatgtagcaggtcacgccaacgtctttattttccctgaacttcaatcaggaaacattggctacaaaattgcccaacggttaggtggctttgaagccttaggaccagtactccaaggtttgaatgcaccaatctcggacctttcccggggtgctagcgaagaagacgtttataaagtctctatcgtaactttggcccaagcataaagtaaatatgtaaaaccagagttggctaattgaatttttcctatagcttggttttcttaaaacaaattaaaagtgcttttcaagaatgagtttaaaaattcttgaaaagcacttttttggttatgcaatcttaatttgcggaaagcgttaagctatttggtacccgtagtcccttgctttttacaatcgggacacagcccctcgacttcgacgtgattagcgataatatcaaatccggtcttagtagcggcgacccggtcgatcttagccaaatcagcggcgtaatcaggataatcgacgtcaataatttttccacaattggtacatattacgtggaaatgggggtgtccataataatcataatgaataccatcttctccactggttaattcaatcactaatccctggtcaacaagcaacttcaaggtattgtagatggttgctaagcttaagttaggggtttttgaatttaatgcgtgaaaaatggtttccacagtcggatggtttcttttttggattaggtattccaaaacaagtcgacgctgaggagtgatgcgaatatgcttttttctcaaatgttcaattgcttcatcgattgtatttttggccatcgtattttctcctatgtcataatcgagtcactaaattaattgaagcacgttttttacttagtttcaaacaggattgaataaagtttgcttggaagctttactttaggtttttaaattaataaaattaaagttaagttggcttaaagaggtgcatttatgaaagaactgcaacgtttacgtagtcagctgagcagtgcggactatcatcacgttaccgtcctgattttagggatgctaaccatgttagtgggggagtttagtactgctttgccaattgcggaaattttacgcaattttaataacggcggtaccgccgtgcaactagtgaacatcttgcctttagcaatcttagcattaatgtatccgttagggccggtatggttacagaagcgaacggtgaccacgttatttagagattcactaaaggtttttattattggaacggtcatcattgggctggcttacacgttgcccctcatgttagtgggcagaattattcaggcggtcggttgcggaatgatactaccgatgtttgccaccttgattagcgccctcctccctgaggatagtcgttttagtgattttaatcaactcgaagatattattaccggagtggcgacgataacggcgttgctgttaacggggatgagctttttaattttacacgcttggcaatgggctaatttattagtaatcttaggcagcttaattgtctacggcatggcaaacgaaattgaaattgatctagaagcacaaaagtatagcatagagtgggttaatttcggcctttctgggggctttttattactgattggcgggatggttttacttacgaaaaccggtctagctttggcaagctggtggcgctggttctttttgcttagcgcgttgatttgcttagcgcgttgatttgcttagcgcgttgatttgcttagcgctttacgtacggcgggagtggcaagttaagaacccgttaattgattttagagggctactagacgtacgttatctgcgagcagttctcttacaggggattggagcagcttcctttgcaagtttattggtaattggagtgctgtacttacgacaaggcctgcactacgcaacgtgggccattggggtatcgttgattccaggaatcgtggtgcggttgctagttcatcacgagaccattccattgttgaaaaacgtttctacaataaaacggattcgaatggccacgggcatcatgatgttaggctggggatgtttgacaattttttcaacgtatctcaacctgctattgtttgtgattttaaccatgttgattgaggcaggacacggtttattgattcaagttggtaagcaacttaaccaacggccgcggtcccggaggttaattaacatggcggatatttttgccggacagtttaaactgatggcaaccagtttgattttgacggtgctatccgtggttttacaaaacgtgaccgaaagttggtcattttcaggcctcccggggcagttatcttcgttagcgggataccgggcagcatttttagtcttttttatcattactatcttgagttggctggtcacgatgattgcgggccggaattataacttaagtaaacatattgtgaagtagttggagaaaataatgacttttaaggtgtttttaagaaaaagcgaaaccttcttaaaagcgttactgaagcgattcaatgaagcggaagtggtaaataattcgatcgtgttagcgtattatttactgctttcatttttccctttagtaatgctgttaggaactttattaccactgtttcaaatccgggtaaataccgttttagagtacatagaaaccgccgtgcctgagaccatttataacattaccgagccaatcgtcaaggattttttaggttctggaaatggcgaactgttttcatttagtttggtaatgacggtcttttcagctagtcaagcggtcgcagcgtttcaacgaaccgttaaccgcgcttatggagtcgccaaataccaaaatccaatcattaaccgggtagtttcctttttccttacggtggtgattattgcgattatggcggtgctggttttcttgtttagttttgggcaaacgttggtcagttatctgacccctattctaaatttaccaacccatttatttgcgttggtcggtcaattaaagtggccagttaccattgtgggcctgttcgtggggctatcattgctttattacctagtgcctaacgctaaaatccggttcaagtacgtaatccccgggacggtgtttgcaacgattggcacgatggtgttgtcccaagtcttttccttttatttaaggattttcgcgcgatccgttacaagttacaagactttgggtacctttattgccattatgttctggcttaatttttcggcaatgatcatcatgtttggcggggtgctaaatgctacctggcaagaattgcgcgaaggtaaaatcatcgaaaccgccggaagtctgcgtaaagtggttggaaaatataaaattaacattcataaataaaaaacagtgtggaaaagtaggttaacaacttgagtaaaagttgtcccttgccacactgtttttaattatactttaacgacgataaaccacttcgaacaattcggttacaaccggatcgtcggttgaaaattgattatcgtaattatccattaatctttcaaatttgtgcaaactacgctcgcgccagtcttcgaggctgcgatctccttcgccttcgttataagcgtgttcagcagaaacccgtaagaagggaattaattccgaaaccacggtctgaattaccgcgacgggtttcatctggccgtctagcagtacgaaatagtctcctgcttgaggaatggcttcctgttcagcggaataataagctaacggtttagtggttgcgcgtttttgccctttgagaatcaaattatttaggcggtcgatctctgcgggctggtcttggggaccaaaccatcgtgtttgaaaacgatcccccttaacgccgctttgttcggtaaatgcttgccaaattgcttcaactggtgttgccattgtatcaggtccttcccgttatcttatcgttgttgcccatatcctaccatcttggaaacgtttccgcaactgaattagtttactcgagataaagccgtcgaagatcctgtaagtcggtttcactcaactctaaggcttccttaaaatagtggtcccaattgccaaatcggtcaataattaactgatgggcccggtccaaactagaggcggcaacggaaaagacgctgttcatcctttggattagttggttagcgtgccggttggcaatttgtttacgcaattcgtcagggtcgcgccggctatagactaagttagtcaataaataatcttcccggatggtactatatggcacttggagtgcggccataattagcattcctgccaccccagtgcgatctttgccagctgcacagtgaaatagaagggactcgttttcttggtcgttagctaataaatcaataaacatttggcggaacgctagacgtgcgtgttcgttaagtaccatcaccaagtagggatcgtacatggcttctacgtgggattggtattgtaaatgttgattagctgggatatccgaggtttcaccatcatgaattggataaaccgggtatgaacggacgatgatgtctgtaggaacgcggtctgggctccaggtcacttcggacggcgagcgtaagtcaatatcatactttaacccgtaatctgctaaaacagcgccatcgtgcttgttgaggcgggataactccccagagcgcaaaagttttcgccatttgatagtttgattattaatgttttggtaaccgccgagctcccgcaggttcacggcgtggggaaggtctaaaattcgttcaggcttcataattcgagggcactcctaactgtggttttaagcctattataacgcagctaagggaaaacatttaccggatcaacaaaaaaggacgccgtttagggcgccctttggggagtaggttattgaaaactacattctgtactttttggaggagtaatcagaataaattttcggatgagaaatggtaatccctacctcctcatccacattctatatcataaatggtaaatgtgaattttttgttaacttagtcttttaaaaatatcaaagtttattaagatttgttaattactctaaataaatttttctaaggtccgctaagtcgtgatccgttaaatgaaggtattctttaaggtaattctgggtggaaccagaaagtttcttaatagcttccattgcggaattatagtacgagatgttcacagattggagcgccttggcactttgaatgaaggccgaatttttattttgtaacttcaagtccattactaggttgtcaattcgcggcttaattgctcgattagtaagtaaataatcggcccggatcgtatcttcgtcaacattcagagcggaaaggaagaaaatggcgcccatgccggtccggtcttttcctgccgtacaatggaaaagtaaagcggagtcttcgtcgctattagctagtaaaacatcaaaaaatttccggtacgccttttgtgcgtgggattggttgatcacgtcgcgataaactcggcgcatttcaactagtccgctggtgggatcgtaattcattttacgttgtagatcactagtttgcttagtactttgggtttcgtcgaccgggaataccggatcaaaagtgtattttgcaccagcagggacttggtcaggtgcctgacttttttcttccggggagcggaagtccacgtcgtatttgatgggatagttagctaaaaaatctaggtccgtttgggataaaccggatagacgtcccgaacgaacgattttattccacttaatcgttttgccatcaagggttttatagccgccaagttcgcggaagtttaatccagttgcaattggtaagagtcttgcacgttccatcttaattcctctctttatacgttaatttcttcttcgacacgttctgccatgttagcgtaaatacgttcacagtctttggtagttccgcggagttcataatcgtcgatcatttcaaaaccgtagtctcgagcgtaacggcgggctgttagacaatactgttcgttaaagttgcggttgccgctccccaccacgccgaggcataattcgcggttgtggtggtaggcaatgtattcacccaacacgttagtcattagttccttaacaccgttgtcaatgccgttaccgccgtccaagtaggtgggaacgaaggcaaaataaggaatctcttcatcagcaaattccgtttcgtccgtgatttccttagcgaaaattagcgggtttttcgggtcttgttggtgcattttttcggcgtagtcacttaaatcgtcgacgaaagattgcgtattacccgcaatcgagatgtacaaaaggtgaatttcatttttcatggttagaactccttactatatttgctgttacagttaattttacgctcctcttaaataaaatgataccacgggttaataacaaactcacttaaactgccgataaagatggaaacgctaccagaatgtagtacaataataggcagtaatgtaaggggtgaaggtagtgaaaccacatttagtcttcatggacattgacggaacgttaattgataatcaccaaaatgttttaccagcaaccaaacaggcaattgaacgactccaacgagaaggtgtaattttttacattgccacggggcggatgctgtcgctagcgaagtcaattcagaaaaaaatcaacgatgatgttgaaatcattgcgtcaaacggatcggtataccaaaaaggaaaccatattcatcaggagcatctaggatggaacgcgttgaaggaaatttaccaaattacgatggacttaggactttcgacgaactttttcaccaccgagatgacctactatactaacaaaaagccgtggcgcctaagtcgtttagcgcgggttcgcgtgatggcggataaaatgggaaatcggggatttgaaaagattcaagatttggaccatctccagcaattgagcagccaaattattaatgggatcacaattgatgatgagccttccgcacgtttgcaagaggcgaaggaacgtttgatggcaaccaaattgctagcggtatcgtcatcgtcgccaaacaatctggaattgattccaagaagaatttcgaaggctacggcggttcgcgcgattatggataagtaccaaatcccggtggaaagaacgttggcattcggtaacgatatgaatgatttggaaatgattcgcgcggtaggaaccggggtggcaatgggaaatagcccggaactgctaaaaaaggaagcggatgcggtgacggaaagtaatttggaaaatggaatcggaaaatttttggagaggtattttaattagagtgctctcaggactgggtagcttccgaggattaacggaatctaaagactaatcgcgggttgggcgattggtctttagatttggttaaccggaagaagctggtcctgatagcacgttttgactaggcagcaaagaaccctcaaggattaataaaatataaggactaatcacgggttaggtgattagtccttatatttgattaaccggaagaagttagggctggaactcgttttgactaggcagcaaagaaccctcaaggattaataaaatataaggactaatcgcgggttgggcgattggtctttagatttggttaaccggaagaagctggtcctgatagcacgttttgactaggcagcaaagaaccctcaaggattaataaaatataaggactaatcacgggttaggtgattagtccttatatttggttaaccggaagaagttagggctggaactcgctttgactaggcagcagagaaccctcgaggattaacggaatctaaagactaatcgcgggttgggcgattggtctttagatttggttaatcggaagaagctggtcctgatagcacgttttgactatgcaacaaagaaccccgaaaataagggattttcaaaggaaaaatccccatatatttacgttgacttatatacccgcagagcgtattctatgttggaattaaagaggtcctagcagggaggcgctgatgatgaatgcaaaaaaggtattagacgtgcggcaaatccaaaagaactttggtaaagttcaggcattgcgaaacgttacttttcaagtaaaccgtggtgaagtttttggatttattgggcccaatggtgcgggaaaaacgacgacaattcgggtgatactggggattattaaagcaagtgcaggaaaagccactatgtttgatcaagatgtttggcaaaatcgggtggcaatccatcgcagacttgcttacgtaccaggtgatgtatatttgtggcctaatctgactggtggcgaaattattgatttattcctaaaaatgaacggagaaaagcattctaagcggactgatgaattaattgaacgttttgatttggacccgaagaaaaaggcgcgaacttattcaaaaggaaatcggcaaaaagtgacgttaattgcggctttttcccaaaatgcggagtgttacatttttgatgaacccacttcggggctagatcccctgatggaagaggtttttcagaaggaagtgttaaaacttaagaacgaaggaaaggcgattctattgtctagccatatattatctgaagtggagcggatgtgtgatcgaattgccattattcgtgaaggaatcattattgagcagggaacgttagatgaaatgcggcacttaacccgcacacaaattaccgtgactactaaagacgatgctgaaacggttaaaatatacctggggtgcacacatttgaggttgatcaacggaacccgaaaaaaattagtttttctgtcgatacggacgcgattagcgaagtgatgaaaattttgacggagaaaaatattttagcaatccaaagcactccgccaactttagaagatctatttctcagatactacaaacaggacgcaaaccaacgtaaggtgattgatcatgaaaaataaaatgaagggttacggactgttgactgcgttaaatttacgtcgtgatcgtttaaacattggcgtttgggtcttagtattagcagggctgatggctaacgtggcgttcaagtttgaaacgctgtacggaactcgccaagcaattgcgtccatcaaagcgaccctcaatacaccggcaatgcaagcctttttcgggacgtttgataccccgttaaaaactagcggagacctgtttgcaaccgaaatgttggtatttatggcaattgcgatgattgcaatgaacatttattttgcaattcgtgctactcgtggcgaggaggatcaaggtcttacggaattggtggtcgctcacgacgttggtaactggtcgataattatggcagcgctcacggaactattcacaatcaatgcggtcacgggagtgctatatagtttagcaatccaatttagttctatggcgggggttgacgcgaatggagcgtggttaattggcttgagtttagcagccggaggattactgtttggcatggttggtttattaatggctcaagtttttgataacgctcgttcggcgacgattgctagttacatgattttgggggtgatgtacgttgcccggatgtttaccgaccttaaaaatcctgcccagacttggtgggttcccttaggatggattgaaaaaattgaagcttttcatgacaataactggacgcccgtttttctaacgttcagctcagggatgctgattggtttagcagtcttggcggttaaccaaagccgagacgtgggcgcgggcatgtatcagggatctgcgggacgggcccgcgcagcacgtaccttacaaggacccattacgttaatcgaaaaattacaacgtcatagtaattggatttggttattttcactatttatcctaggcggaatgctcggttcaatttttgatacggtgggagatattttaaaatctaacccgaccatgcaacttgttatgcaaaaatcggcaatccacagtgctaatcaccaaattttgcttaatttcatttcaattattggcatgattatggctgttttaggaacgattccagcagtgatgagcgttaataaactccatggtgaccaacaacgcggttatcttgaaaacgtgtatgctaaggcggtttcgcgcaaccgcttgttgactgggtacgtggccaacggagtgggaattggtgttctaggttttgcggtaggactgttgggagttgacgttgcgggaaattgggtgctgacccagggtgacattagctttgcagcatacgtaaaaactttcattgcctttgctcccacaattatcttgaccgttggcctagcagtctgttttaacggaattgcgccgaagttaaacggaattacctggttgtatctggggtacgcattctttactagttatcttggcggtctacttaaactaccagcctggactaagcaacttaccggattaggatggaccaagatggttcctttagacaaggttaattacagttatgtgtttgctttgatagcgctcgggttacttttaatggtcattggttattggggatttaaccggcgcgacctcgcttaaaagcgatttttagccaaaataaaaagcagggagataatccctgctttttgtgtacctagcttaatcggtaaagtgatctacttccggaacgaccggcggcacatcggcgagctcttcaggttttagtttgtggaccaagaaccagtcgatatgggcgttttcgttatcaagcacttcgaaatcatagttttgaattcgaacgtgttcatgcaccttgatttccgggttgtgatcgatgacgtaaccaccaagggtaaccacgtcttcttcttcaaagtcgggtacgtcaatgccaaagtaccgttcaaaatcgtacaccgtcatttttccgctaaccttgaagtaaccgtcagcttctttatgaatgtagtctccagaaacgtcgtcaatttcgtcattgatgttgccgaaaacttcttcgtagatatccttatcggtgatgattccacttgttccgccgtattcgtcaaccactacggaaatcggaacttgttttttaatcatttgttctaggacgtcttgcaacgccagcgtttcaggtacggtaatgatgttacgtaataacttgctgaccttaatattaccgtccacttggctttgccgaataatgtcgtagttgtagatgtaaccgaggattttatccttatcgttattagcaactactgggaaacggctaaagcgactttgtaagtattggcgtaacgcatcgtctaccgtgctgtcgacatctaaaactactaattgagttcggtcgatcatgatgtctttggcgaccttatcattaaaatcaaaggcccgttgcatataaacgtagtcgtttttgtctaattctccgccgctaaccgcgtttttagaaaggtttaaaatttctgcttgggagaagatttctgagttctcgtcggcaggctgcattcccattaaccggacaattccgtttgccgaagcgttcagtaaccacacgaatggataaaaagcagtgtggaaatagtgaagcggagttaccacccacatcaaaaccttcaacggaatgtcgatactgatgttcttgggaacgatttcggtgattaccacttctaagtaagttagtagtagaaccccgattactgcccccacaatgtgcagcgaggcactgttaatcatgtgtgtagccccaaatagttcgaccacgaaatattcaaccgttgactcaccaatccaaccgaggatgatcccacagattgaggtaccaacctgagtagttgaaagatattcgtttaggcgactaaccatccgcattgccaatcgatatttcttttgcttgcgtgcgctagtggcttctttttcggcttcttctaaggcactgggccgggtttgcacaagggcaaattcggcggcaacgaagaagtaagctaatataaaagtgataagtatcacaatcaggttagagactatctgaccgctatccaaaaataattccccatttcttttttctcgttattgttatattatacaacgttaaaattcaaattagtatgccaagaaccgtactttaccgaaactaacgggatatttcaaggaatcattcccaaaaaatttattcgttgactagctgtaacaattgtaatcgcttttattggtggtatgatgatgttgtttaagaagctttagaatttatctggaggtatggaaatgaagcaaattaacgtgggcggcatgcacgcttccaacgtagcgttaggaatcatgcggatggatgcgctctccgacgaaaaggccgcggaagtaattgatgcggctgtagatgcggggattaactatattgactcggcagatttatacggacatggagcatcaagtgcaaaatttaaggctggtcttaagctagctaaggctagtcgcgatgaactgtacatccagtccaagggtggcattgtcagcgaaaatgatggggacattccgtacggcaaccgctacaactttagcaagcaacatttgattgccgcggtagatggtgaactacagcgcttgggtgtggattacttagattcatttttacttcaccgaccagatccgttaatggaacctgcagaaatcgcggaagcctttgatgaattacaaacggcgggcaaagtacggcatttcggggtgtccaactttaacccgatgcaagtagaactattacaaaaatatttgcaacaaaagctaatcattaaccagctccaatttggcattatgcatacggggatgattgactttggcatgcacaccaacatgactgacgaccggagtgtcaaccacgatggtcagattcttgaatattcccggattcatgacatgacgattcaagcgtggtcaccttaccaatacggattcttcgacggagtcttcattgataatccgaagttccccgaattgaataagaaaatgcaagaaattgcggatatttatggggtaaccaagaatgccattgccacggcatggattttacgtcatcccgctcaattccaagtattattagggaccatgaatccgcaacggattaaagaatcggcagctggtagcggcgtggagcttaccggacaagaatggtacgacatttattacgctgcgggcaacgatttaccgtaggcgatgaaaaaagcagctaaaaaatcattttaggattttgtcttttaaatgaagtcaaaagtcagtttgttccgcttaacccaaaagcgaccatcatgcccaatttaggcataatgatcgctttttagttagtgctcacaaactactcgacttttgtcccacactcttttttaggaactattgcttattgacgtcactaatcttcatggtaatgtttttaggtttgtcttggacgaccacgatggttcccttgccaagaaagttcttcgaaccgctgtatttgatagtgtattccttagcaacggcacctgaattttgcaggcccattacgtaaatttcgtcatcggtaaaatcgtcgctaaaggcaaacgcaattacgggagtaaccacaatttggtcctttttcatttgtttcaacgtatcccacaagcctttaattacttcgcttgggaactgttccttgacttcttcagcaacttttctttttttagttggatcaaacattttactttcctccacctgtgaataatatgaatagattaccataaaagatgacttttgataattattgtttattacacgaggtaatctagtttataaaactaggtaatgatgttacaataaaagaaaacaaataaggaggttttagcaatgagtaattataaagaatatcaacggtggttggaactagtcagccgggtggaattaccacactgggatgatttgccaaattttgatttgtatatggaccaagtggtggcgttgatgacggaatacacgggacctttaggcctggaagcagtgacgccggcaatgatcaacaactacgtgaaaaataaagtgattgtcgcaccagcgaagaagaagtatcaggtaatgcaaatcgcggacatcctcttgttgacgttgctaaagcaatccttttcgattcaagagattcgttcgggaattgaccgggtaaccgcaagtgaatatccgaagcaggcatatgaccggtttattgatttgctaaataagaagattagcttgattggtaaatcaagaccagatcgccacgcagaaaacctaacggaccaactactggaagcagcatcagatatggtggtggaccagttggaaaccaaccaactagtaaaaatagtaaagaattcaaagtcgcacgaaccaacgaaaataaaatagagcgttctggagcccgggtagctcttgaggactaacagaattagggactgatcgcgggttaggcgattggtccctaattctgttagtcctcaagagctgggatccataacgcgtttcgactatgcagcatttaaaactgtcagttggatgggtaatttttttagggtgaatgtttgcacagaaccttgttaaactagccaaagcatgtaaaattagttttggaaataataggatatcaatatttgcggacgtaaataatatctacccaaaggaagtttaaagaaatgaagtttgccattcgcgcgcaaaatctcgaatataagctcacggaaactgaagaaaatattgtcgagtatattttggtacaccaagctgaggtaattaacatgaaaatcgttaccttggcggaacgcttttttaccgtgcccaataccattaccagattttgccgtaagttaggttatggcggatttaccgaattaaaagtggaactgcgccacgaactcctcgaaaagcaaactggcaatcaacaactggccttaattgaggaaaactttggattagttgatgagaaacgggaaataaaattagctaagttactccaaaaagcacggttagttaacttttacgcgcaagatcaaacccatttaattgctgaattaggggtagaatgttttcaagttttagacagcaaatttcagctcttaggttatgaaaaagaggtgttgagccggattaacaatggagcaggggacgtcttcttcttcatttcaatttcaggtgaaacacctgcgattgttaatttagcaaaaaaagccaaggagcggggacatcaggtggttagcttaactaatctgtcgaataattcgttagcggcaatcgcggacgttgccatttattgcttgacagaggtcaattatattgcaggaatcgaagttactgataaaactccgatgtttgtgattttgcaatccctgtttcagcgttacttaaaattgtgtaaaattacaccaaaaaagaccgaaacgttatagtttcggtctttttttctagttttaccgtctagctgtcctttcgatggtaaccttagatcaataaaacgattacataggaggttacctttatgtcaaagggaaagaaaagaatcgctttaggaggattttttcaagaactaggaaaaacatttatgctaccagttgctttaatggcatttatggggttgttattagggcttggaagttctttttctagtccaaccactattgatgcatttccatttttaggaaatagcattctccaagtggtttttaaatacatgtcggccatcggcggttttgcttttaataacttagcggtaatgtttgcgatggcgattcctctgggacttgccaaaaaggaaaagggagttgctgcattttccgggttcgttggttacatggtaatgaatttagcaattaatttttatttaggtttaactaaccaacttgccgacgcggatgcaatgcaaaaggcggggcaatcgctagttttaggtgttcaaaccatcgaaatgggcgtgctgggcggaattataaccggaataattgtgtatgacttgaataaaaaatattgcacgattcaattgccggatagtttcgctttctttggcggtgcgcgtttcgtaccgatcattacgtcgttagtgatggccgtcgtggggatcattttgccaattatttggccggtattcgcctttttaattaacggagtaggggccttgattcacggtgccggaccatttggaccaatgttgttcttctcgggtgaacgattgctgttaccatttggactacatcacattctcgttgccaccatccggtttacccaagcaggtggcaccatgttgatagatggtcaccaagtttcgggggccctcaacattttctactcggaattacaaaatcatttgccaatttcgcatagtgcgacccaatttttatctcaaggaaagatgccgacctttatgtttggtctccctggcgcagccttagcgatgtaccatactgccaaacccgaaaatcgggccaaaattaaggggctattaatttctgggttcattgcgacctttattactggaattacggaaccaattgaatttttgttcctcttcatcagtccgttcctctggcttttccacgtctttatgactggatttggagccttagtggttagcttgttaggggttaacattggtaatactgacggtggagtcctcgacttcttgatttttggggttatgcaaggcacccaaactaagtggtacttaattccaattgtggggatcttttggtttttggcatactatttcactttcaagaaatttatcctctggcgcgatttaaaaacgccgggtcgggaagttgctacggaaccagaatatacggatgctgaaattcggacgagtggtaacgctggtggatacgacattccgggaattctcaaagcgcttggtggaaaaagcaatattgtcaccttggataactgcatcacccgtttgagattgattgttaaggacggctcaatcatcaatgacgaggaacttcaaaaattaggagctttaggagtagttcatttagatgatacaagtgtccaagtaatcattggaactaaggttactaccgtgcgtaacggattagatgcccttttagaaggtggcgaacccgaagctaaaaagttccaaattggagcgccattagctggaaaagcggtgccattaacggaagttccggatgcggttttttcaaccggcatgattgggcagggtgcggcaatccagcctactgacggccaagtggttgccccagtagacggggtggtcacgacggtctttcctactaaacacgcaattggaattaaagcaactaacggaatggaaattttaattcatttgggaattgataccgtcaaactagacggaaagccgtttgagaccaaggttgccgttgacgaacaggttaaggccggtgatctattagctacggcagactggcaaatggtagcggatgcggggctagctacggttacgccagtggtggttactaattttgctgagtacactaacgtcgggatgattgctaagggaatggtagagaaaaacacgccaatcattgaggttgaaagtgcctaagttgtaaaagcagagattgaaaagagaaggtcgtgaaattttgataaattttgatgaagtgattaatcgaaaaggtacttattgcacgcaatgggattatgtgcaggaccgatttggcaaggcagacttattgccgtttaccatttcagataccgactttgcggtgccacctagcgtaaatgaggcgattcaaaagaggattcaatacccaatttatggttacacccggtggaaccacgctgattttaagcaagccacgcagcattggtttcaaaagcgctttggattgcgggtgaacggcgagtggatcgtgtacagcccgtcggtaatctattcaatttcccaactattacaaataaagtcaaaaccaggtgagggagtggtaatgcaaactcctgcctacgatgccttttttaagactattcgtgctaaccaacgaaaattagttgagaatccgttgcggtatcaaaatgggcagtacacgattgattttgcggatttggaagaaaagctagccgatcctaataatcaaattatgttgctctgttcgccacataatcccactggtcgcgtctggaccacgacagaattacaaaaaatggttcaactatgcgaaaagtaccacgtttttatcatcgcggatgaaattcacatggacgtcgtgcgaaaaaatgtgcgtcaccaaaatattctaaagtatgtggagcaaaacgccgcgttacttacttcgggaactaaaacttttaactttccaggattgattttttcatatttgttaatcccagatccagaattaagaacccagtttaactacgccttaaagagtaaggacggcctgtcttcatgtagtattttaggaatggaagctacgatggctgcgtacaaaaatggatcagcgtgggtggacgagttaaatgagtacgtggaagctaacgtggaactggttcgtacgtatttaaaacagcacttgccccaagttaagctggtagaatcggaagcaacgtatctgttgtggttagacgtaaccgacctgccgctttccatggaaactattcaaaagtattgtgtagaagtgggaaaggttgccattatgggtggcggcatttatggcggaaatggtaagcagtttttacggcttaacgtcggatgcccgaagacgaaggttcaagatggcttggaacgcttgcaacaaagcattactgcggccctccaataaaaaaataatcccccggaccaaccggcaatttgccaacggttcgggggattattttattcagtaatatcaccaaaggtaccatgaactaagtcagcgaggtccgtagcttttaactgaacggaacggccaattttacccgaagaaacgataatagttccttgttccttagcgatttccgaaatgtaaattggaaatcccttggtttcgtaaatgccaatcggggtgttggcaccgtgttcgtacccagtcgttgccaccaagttctttagcggaatcataccgacttttttatttccggacagcttcgctaattttttatagctaaggtgttcgtccacgggaattaccccaaccagcggaccggtttggctgccggttaaagcgagggttttataaatgacgtgatcgtcgattccgatgtggtcgacgttgagttgcttaacgtccccatcttggtacgttggaaaaacgaattgttggtactcaattttatgtttatctaaaatttgttctactaaggttttggaaagttttccttttttctttttcttcgacataatctatcacccagcaatgtattttagcacattgagcgaatccctcacaaaatgaaagtggtaagtttgctataatgatatagcaactaatctacaggagataatttaatgaaagatctgatttgccgaaaaatcatccatgatttgaaaaaacgtatctttaataatgaatttccgtcaatgcgtttgccggacgaacgctctctaacggcagaatataacgttagccgcagttccgtaaaacgggcgcttagctcgatggcgcaagaggggattgtgtttaaaaaacggggatcgggaacctttatcaacccgctgtacttaaagagccagtcatcgtttaattacgaaggttccaacatcggaattaccgacagtttgaaatccaacggaaaaaagcaggggattaaggtgctagatttttccgtgattccagccaccaaaagcatgaagaccgacctgttcttaaatgacggggattttgtctataaaattcggcgcctgcgcttgttagatgaggagccgatcatgattgaaacgggctacatccccattaaaatcgcgccagaattatccaaggccattgtggagaaatcaatttttaattacttggaagacgcgaagggacaacaagtaacccgttcatatatgtcgattcaagtagctccttctaaccaagaggaccaagaattactaggattaactgctaacgaaccggtcggcattatgtccggaatttttttcatggatgacggaaccccctttgaaatttcaaatatgcgaatacattaccggcatatgaattacagcacgtttgtatcagtagattaggtttaatttttaaaaataaataacggtaaattaccatttttaaccgagtatgcagcacaaaggaggtttttagaacctccacaatcgttgtaacggcgctgtttgtacgcggctatttttattttttaaaaattggaccgtatcaatttataaaatgattgacctttttcgagaaagcggttatacttatctcgtaaattaattaatcagtttttcgctcacgaaaggaagattacgatgacagactattcatctaaagcttactttgacaaacttgaaaagttttggcgcgcagctaactacctctcagttggtcaattgtatttaaaagacaacccattattgaagcgtgacgttaaggcctccgacgttaaggttcacccaatcggacactggggaacgattcctggtcaaaactacatttacgctcacttgaaccgggttattaacaagtacggcgttaacatgttctatatcgaaggaccaggtcatggtggacaagtaatggtttctacttcataccttgacggttcatacaccgaagcttacccagcaattacccaagacgaagaaggaatgaagaaactcttcaaacaattctcttggccgggtggggttgcttcacatgccgctcctgtaacaccaggttcaatccacgaaggtggcgaacttggttactcactttctcacggtgtgggtgctatcttagataacccagaccaaattgctgcagtagtaattggtgatggggaagctgaaactggtcctttggcaacatcatggaaccacaaccgtttcatcaacccaattactgacggtgcggtattgccaatcttggacatcaacggttacaagttgagtaacccaacccttacttcccggatgacggacgaagaattagctgaattcttccacagccaacattgggacccatacttcgttgaaggcgacgattccgaagcaatggatcctaagatggctgaagtaatggacaaggcaatcgaaaagatccaagaaattcaaaagaatgctcgtgaaaaccatgacgaatcattaccatactggccagtaatcgtcttccgttcaccaaagggctggactggtccaaagacttgggacggtaaggttatcgaaggtactttccgtgctcaccaaattccaattcctgttgaccaaaacaacatggaacacgttgatgcactagttgactggatgaagtcatacaaaccagaagaattgtttgacgaagatggtcacatcgaccaagacatccttgacttcgtgccaaagggtgacaagcggatggctgctaacccaatcactaatggtggggttcacccaactgacttgaacttgcctgacttccgccaatacgcggttgacacaagcaagcgtggtctcaacatgaagcaagatatgttggtatggtccgactacttgcgtgacgtggttactaagaatccaaagaacttcagaatgtttggtcctgacgaaacgatgtcaaaccgtctctatggcctattcgaagtaactaaccgtcaatggatggattcagtcaagaaggactgggatgaagcagttgctccagaaggtcgcattcttgatgcacaactttccgaacactctgcagaaggctggcttgaagcatacaccttaactggtcgtcacggaatcttcactagttatgaagcattccttcgggtagttgactcaatgcttacccaacacttcaagtggttacggaaggcttctgaattagactggcgtcgtgattacccatcattgaacattgtttcaacttcaacaagtttccaacaagatcataatggttacactcaccaagacccaggtatcttaactcacttagctgaaaagaaaccagaattcattcgcgaatacttgccagctgacgcaaactcattgttagcaatcagcccattagtaatgaatgatcgtggtaaagttaacttgatcattgcatctaagcaaccacgtccacaattctactcaatggctgaagcagaaatgcttgctaacaacggtttgggaatcatcgactgggcaagcaccacgaatggtgaagaaccagacgtagttatcgctgctgctggtactgaaccaaacatggaaagcttggctgcaattaacatcttgcacgaccgcttcccagaattgaagattcgctttatcaacgttattgacctattgaagttacaaagtccaaaggttaaccctaacggtttgagcgacgaagaattcgaccgctacttcactaaggacaaaccagtaatcttcgccttccatggtttcgaagacttgattcgttcaatcttctttgaccgtcacaaccataacttacacgttcatggttaccgtgaagaaggggacattactactccatttgatatgcgggtgcttaacgaacttgaccgcttccacttggctcaagacgtaatcaactcaattccagaatttaacgaaaagggtgcagactttgcccaagaaatggacaatatccttgctcgccatcacgaatacattcgtgaccatggtgacgaccttccagaagttaaagactgggtatggaaagacgttaaataattaaagcttaaagattaaacaataaaagctgaaagcaaaggctcttacgggcggctgctttcagcttttttttgttgtagtaatatatggaagtaactattgcaaacaagagcttagagaagttaatccacgtgtaaatctacagagtcaaataattgtgcaatttgttcaggagtggttcgcttcatggaaagcggtggaagctggtctttatcaaaccattgcatcgcaaccgtttcactgttcttaacgaattcaccactttccactgtacaagcgaaaataaatttataatactgaaaagtttgcgggacgtcttttcttagggaggtgtcatagacagcgcgaagggtagccgtgtttacggtcagcccagtttcttcgtgcacttctttaatgacgttttcttttagggtccagccaatttctgcaaaaccgccgggaagagcccattcaccgtgggagttttccacgagcaatacctgatttttttggcgaataaaggctcgcacgtccactttgggagttggatatcccgcctcgtccttaaagagttctgccacggtggttacttgcacatttccaagctcactcaaacgttgcatcgcaagctgacggagatcttgataacgttcgatatcaaagcgatcgcttgcataagctaatccagcttcgctaattgctaatattcgacgaatgaaaaaaagttcttccaaaatagatgccacctttacttacaaattaatctccaacatcaaaagctggctcagccaacgaaattccaaagtaatcgggtaccggtgcagttaccgtttgccagctttggctaaagggcaagggaaatttgacttgccaagagtgcagccgcatgggagctccgtcagcaagtgaattatacaaagggtctcccacgataggatgccctaaggctgcaaggtgaaccctaatttggtgggtacgaccggttgctaactgaacgcgtagtaggctccgttcagcaaattcacgaaccacttggtagtgagtagtggccggttgcgctcccggaccgttgatttgtcgtttacgctggtcgtgagggtcaagtccaatgggaagcgtgatggttccgctacggcttttcaagtgaccttctaccatgcacaagtacgtccgttgaattaatttttgactgatttgccgactaagaattgggacaacaaccggatttttggctaccaaaagggcgccactagtccactggtccaaacgatgaacgttatacgcgttggaatccttcttggcaaagtacgcttgcaagaagttaatcatgcttcccaactcgtgtggttggttagcgtgcgttttaatccccgcgggtttattaaccacaagaaggtcgtcattttcaaacaaaacgtcaggactttgggaaggatccgggtcaaatggcggaagcggggtagcaaagtcactttctttgaaggttaacgaaatcaagtctccgctacggacaacggtgctaaccggttggtaccgctggtttaccaaaactcggcgttccgtgcgtaaaaaatggacgaccttccgagaaagccaccaagttttttgcagtagttctcgtaaagtttggggagggtaagattggtctagtttaatatggtacgtccaggtcataaaaactcctttttgccataaaaaaacgatccataaaattatggaccgcttttttacatacttaattattttttggccttcttttcaggtttaactactaacacgtcacaaaccgcgttccgacttacgtaagtagcaactgaaccaaccattaagcgttctagcgcgtttaaaccagtagaaccaatcataatcaattcgtttttgtgatcctttggaaattcacgagcaattaccggcttaggattaccaaagcggatatgaatgctaacgtcggtaaccccagcatcttcagctcttttctttagttcttctaagcgatgttggacgtcttcagaaagcttgtagattacatctccactgaccgctccaccataggtgtcactaaattggttaacttctaagacatttaggatatctagatgagtgttattccgtttagcaacttcaattgcccggtcaacgacaacctctgtcatttttgaaccgtcaacaggtgccaagatatttttgtattgttgtagcatgttcccaccatccaatcatcatttcttatactaataatatcattttcaaaatgaattgtaagcctttttacctttaaattctggatattttcgctttatcagaggctaaaaaataaaaaatgaaatcggtttattataacgcccgaaacagtggtatattggtatggtaaacgggcaacggggaatggttccccatgctaatttaaattaggagcgatacataatgttattgggtagtattgaagccggcggtaccaaatttgtgtgtgccgtgggaaacgaaaattatcaagtacaggatcaaacgcaatttccaacggctactccggaggaagccttacaacgaacggtcgattactttaaaaaatttgacattgcggcgttaagcattgcgtcgtttggaccagttgaaattcggcacagttcgccaaagtatggctatgtaaccactacgccaaagccaggttgggcggatacggattttgtagggtacattaaaaaggaatttgatattccgatttttttgactaccgacgtcaatggttcggcgtacggggaatacgtaatggccaccctcgctaacgaaaaaatcaattcgttaacgtattatacaattggtaccggtgtgggtgcgggagcaatcgtgaacggccacttgatcgggggaatcggtcatcctgaaatgggccacgttttagtaaagcggcaccctgacgatctagattttaagggtgtttgcccgtaccacggggactgtttagaaggattggttgctgggccaacgtttgaggctcgcttaggcgttaagggcgcagaagttccgcattcagatcccgtctgggacattatggcttactatacggcacaagccgctattcaaacgacccttacgctacgtccggggaagattgtttttggcggcggggtaaccaacccggatttcttggagaaggttcgcaaatcatttaaagaactcttgaacggctacgtacaagttccggatcttgataagtacctcgtgatgccggaagttgccaataatggttcagccaccctgggtaactttgcgttagctgaaaaattattagaagtttaataagcttttttgctagggatagactgatcaaattggttttacgacttaaacaacgcatcgtaacgacttgaaataaaaatagtcgcttagctaccgcttgattgtgcagtagctaggcgactattattttttagtactgagtgtgggatatcgttcaaaaaattcctatagcagcggtaaaatcaagttggtccataaccaagaaattggcatgataacgatcataatcgggatcatgtcggcagttggaaacatcttgacttggataattcggaaaccgctcgctaacattaaaactccgcctccagctttaaagtccagaatcatatctggggtggtgagggggaagatcacgtgagcagcgaggaatagggcggttagaatgattaaaagcgggaccgcaattaaggaaaccacgtatcctaaattggccgcaaaaatcaatgccgtaaagaaatccaaaattgctttggaaattaaaatcgacggatcgccactcattccttcaatcaaagaaccgtaaataccggttccactcgcacagaaaaggacgattacggtaactaaattagcgtcgtaagtgatcttgtccaaactaccgttacccgttttattggaggggagcaagcgtgaaatgagacgttgcatattttctgcgccccggttaattaacacgccgagtcggaataggagacccaatccagttccgatgattaccgcgaaaattaccgcggctaagtttttcatgggggcaattgcgtaaattcccatggtcatggaacaaatcccaaaggccatgtttagaccttctttgaaccgttcggacatcgcgccgccacttaaggccccaatgattcccccaaagaaaattgctgaaacgctaactatgattccaattggtaaattaaatcctccctctttttttactcacaaaagattagtttagtcattgactcggaaaagcgcaattcctttttatgtgctaaaatattccaaataggaataggtcgggagaaagcaatggatacaaaaaaattaacgacgttggttgacttggcagaaacccaaagttacagcgagactgcggaaaggttatttttgtcgcaatcgaccgtgtcaaaacacattatggctttagaaaaggaatgggacgttaagcttttttcgcgcgctcaccggcaagtacagttaactgcggcaggaaaaaagattttgcccgcggttcaacaattattgcggcaggaaaaagaattacaaaccacggtggcaatcgcaaacgccaaccacgcccagacgctagttattcacggaattgcttccattgcccagtatcaagcttttaacatcattactaaatttactagccagtatccgaacgtaaagctgaagttcagtgaagccgaggtgccggacctaaatgaggatttaaaacggcaggacgttgacgtgatttttactcgaatttacgaggatcacgatccgcgttatgacacaatcgttaacgaaacggaccattacgtggtgttggtgccgaagaatagtccgctggcgcaagctaaacaactaagcattgagatgatcaaggaccaacaactccttttactccggaacacaattaccgttgcgaaccccttaaacgaagttttgaaacgttcgttagttactccgcggattgtttatgaaggacagcgaattgatttgattttagaaatgttaaaccaagggatgggcgtttcggtagtgatgaacaagtcgtttgatttgacgggatttgataacatcaaggccgtaccactggttcctgaaatctgtagtcgcctagtcttcttaaaaagaagggaccggactgcaccagtggttaatctgttttgggactttgcaaaacgggaaattgagcaagcaaaagaatagcaagtaaaaaataaccctcacagcaaggtgtccacctagttgtgagggttgtttaacttaagaagctccgggttatttccaccatagtttgattaaagcttgggtaccgtcgtcgccaagaccttgagcattaactaaattgtcgtaaagctgggtggctaaacgagtggctggcaaatcaatgtgcattcgcttagcttcagttaaggtgatgttgaggtcctttaaaaagtgtttagcaaagaatcccggcgtgtaatcatccttcagaatccgcggtacgtaattatccaggctccagttatcggcgcttccgtgggaaacggtatctaagactttttgtaaatctaaattagcggccttcgcgtaaaccagcatttcagttaagccggtcatcgtgccggcaatcatgatttggttagccatcttagcgtgttgtccggtaccaaagtccccaaagtaattcgctgcttgtgaaatttcggggaagaggggttccatttttttaaacgcctcctggtgcccgccagccatgacggttaaggtagcgtttttagcaccaatgtcaccgccagaaacgggagcatcgagtgccaacgccccgatttcttcagcccggtgaccaatttcttcagcgagggttggtgaactggtggtcatatcaacaactaactggtcggctttcaacgttgtaaaaataccgttttccccaaagtaaatttccttaacgtcttgcgggaaaccaaccatggtaatgatgatgggtgcttgggtggtcaactgagcgggcgagtcaacccaaattgccccgtggtcaattacttcttgggcgtgggccttagtccggttgtagacaaatacctgatgatggtgctttaacaaattattaataattcccgtacccattactccagtaccgataaatccaattttcatgtgaacttcctcctgtcttaaatcaagcgcattaaatcagcgcaatgggaaaacaatgtatgtatgtaaaaaaagagttatgaatgttaaacttttatttagaaacttaactagtgagggataaaatgaaaattctagccaacgacgtgattcaaaccttaaaagcgggcgactttgccagtcaaacgtttaaaatcggaaaagcaacgcttaaaaaagctgacgggaccggcgcagatgaggcgtttaactacttaaaaacggcggttaaccagcacggaattgccgaagcggtcatcaacgttaacaaagacgtggtgattaagttacaatcaaacgtaattaacctaccgctattataccccgcagccgtcgaaaaattaaccgaggctgaccaagaatacgatttgaacgtatatgcagtcatcgaagctgagaagattaattcttcacatttacgaattgatcaaattggaacggcggatgatctgctaaatgacaacccggacttacgtttaaatttccgggactgggttaaagaacagtttgaacgcttagatcaaccagctgcaaaatcgactaccgaatagcaggagggagattatgaaaagaagatttgaattgattattggtttggcaatcgtcttatttgtgggggcggtttttactagtgcacgagcataccaaaaacaagttcgtcacgatgctaaagttgaactacaaaaatcagctaagcaaaaggctttacccaaaagttcggccaaggataccggactagctggggatgaagcccccacggcagaaacggcgaaagcttctaccaagacgaaaatgaaccccgtaaattggaaaaagtcctcgcaaaaaaatgaataccctgatttagataagcatccccaggcttacttgaaggtttccattgccaagcaacgggtttacgtgatggacggaaaaaaggtcttatacaccatgtatgcatccaccggatccaaggatagtccgacaccaaccggaactttccacatccaaaaagaacggggcgacttcttctataacgcagcttctaaggaaggggctaagtactgggtttcgtttaaggatcacgggatttaccttttccacaccgttccgacggataagaacggtaaatttatccctaaagaagcgcaacaactgggtaaggaagcccaatcacatggctgtgtaaggttatcggttccagatgcaaaatggatttataagaacgttccggagggtatgaaagttgaaatacattaagatgattcaagaatggctacaccggccccgacattttattgtagaagtagggtggggcctaggacttttgttaggactgctgttagtggtgaaaatcattggtcgtttagttttgcacactaccttcattggctttggtaccatccttggcgtgatggtactttacctagtaattatttttggcttacgtgctttagaaattaaattacgcaaataaaaaaggcgggttcccggaaccacctgagtaattgttaggtggcatcggtttgaacccgtccttttattttgcgccaaattaattcgatcatgaacggaacgaaaattagcattaggaaaattaaggtgaagtattggcgaacaaaagcggtgcgaccgaagaagtagccggcaaagcagcaagtcaatacccacagtaacacgccagcaaagttgagcttattgaaacggcgccaatccatctgggtcgttcccgcaataatgggaacgaacaatcccacgaaggggatgaaccgggaaaagaccagcgattttttagtgttcttatcaaacagcttttgggtttgatctaactgcggagaatcgctgattttttgagcgattttatttttcgattccaaattcacaccgtaccaatacttaaccatggctccggtagttgcggcagcgatgaaagttagcagcagtagaaaaatatttaaatgtgctggggccgtagaagcaatcgttccagttaagaataaaacggattgccctggcaaaaaagagaagaaaataaaggcagtttccaagaatatccagataaacaagatcaagtaaacccactgatttaattgggttgttaagggggttaggtaggataacggatgaactagaaatccccaaattaaatttagcatcgtacacctccttatcgtttttatggtagtctcatgatagagttttttgggcgagattgcaatttttaggtccaagctggttgttgtgcaaccatttttgtgatacattagttacatgcgatgagtcgagatgggtcaggcagcttcggctgtttcgctgcggcgactagtgaccatttcaccggcacacattaactaccggattttgtaggtgtgggtcaatttgggtgtgtgagccactcaacgaccaattcagcaattttgctgatgaccggtttataaaagaccatgacgtaatttcggttacgtcatggtctttttttgtccgcttttttagtttatttgattaggtatacttggtcatgaattaaatcaaacggctgaaaatgttggtttaatttagcagcggcttttggttcaaccaattgagcaatttgccaaaactcgttactgttggtggcgccgttttgttcgccaatgcagattaataggggctggttaggcaaactgcgcagttttttcaaaacttggacatcaatgtccagcccatcgggagcccaagccataattacgtaatcaacttgcgggccatacttttcgatggcagcgagggcatccaaaggctccacttcggtcaccaaatgtcgaccagtttcattttcggattgccaagcaagcgagtctgtagcaattacgggctggtctttcatccgcaatccgtgactaatatagccgttgccagccatgatttctagggtgggacgtccggctaaataggcggttagatcgttaattaacggtgcggaaatgtaagcccacatgccgtatcgttcttccaagaaatcccggtacgaacgcaaaagtttatctaacttgggtagttcgcgagttaatttttcccaaagacgatctccccgcggatcacctaacggaaagcgttctttgaggcggttaaaaatttgttcttgaacgtcgtcgggcaattctaaaagcggcaattgctggggcaatagattttgtcgaattaaacgctcgctttccaatacttggttaatcaaaaaaacaattgaaccataatctttaaataaattgcgataattggttaattggtgaaggtaacgatcagacgattgcgttgtttgcgccttttttaattgtcgccgaagctttttcaattttttcgggttcattacttagtcatcgttccttttctgccaatttaaatcaagctcttcttgttccatggaagagttaattgggcgtcgtttcttaccgtggaaatagccgttgattaattgaaaaacttcgtagcggtcgtcactactcaacgttttatgatcaaagcttaattgacggccagataggaatagtttgcttaaatcataggcgttaagcgcggagcgaccacacagatagtccatgcttacgtcgaaatattcggctaattttttcacttccagataggatggggtgcggattccccgttcccaattcccaatttgattagcggtgtttggattttcatccggaaataattcatttaattcttgagcaagcacctccaaagtgatgtgcttaccgtggcgtaaagcgcgcaaacgttctggaaacatagaccgtcctcctgtgaataatattctagacctattttaatacagttcgagggtatgcgacaaattaaagtaaatgtcacaagcaaattggggccaaattcgggattagcgtaattttccgccaagggcagtaaaaaaacgctatactaaaaaagttggtttaggaggaatacgatgaaaaaattttggaaatggcttttggtggtactagcggttatgctcgtggtggacttaggcgcggggatgtattttttccacgttgcggaagttcgcggtaccaaaagttttattaagaacgacggaaaaatcactaaaaacgatccgttgcggacccaaaaattatggtatcaacgggtaaaaaaggaaaagtggacgatgaaatcggcgtccggtaacttgaagctggaagcctattacattccagcggcccgtcccacaaataaaacggtcattttagcgcatggttttctacaaaataaagacggcgaaggcgccccagcagccatgtttcatgatttaggctataacgtactggctccggatgatcgggctcacggtaatagcgaggggaagctaattggatacggttggttagaccggcgtgactatatcaaatggatgaacaaactattgcgtgagaagggcgaacatcaaaagctggtgatgtacggggttagcatgggtggtgcaaccacgatgatgatcagtggggagcctgacgttccgcaccaggtgaaggcgtacatcgaggattgtggttatacgagcgtggaagatgaaattacttaccaagccaaatcaatgtaccacctcccgaagtggccactggtaccgacggttagtttaatttcgaagattcgggcgggctacagttatggcgaagctagtgccatgaagcagttggcaaaaaatcatcaaccgatgatgttcattcacggtggaaaagatgactttgttcctaccaaaatgattgaccagctgtacgctgccacgaaggggcctaaagaaaagtacgtggtgaaggacgcggggcacgcgaaggctatgcaaacggactatcagcaataccgcgaccgagttaagaaatttttagaaaagaacgtttagcagatttttcaacaagggatgttgaaaactacgcacccagacaaagtgtgaataaatttgtaaaaagaaaaaaagtcttaaaagaatcgttttaaacgacaatccttttaagacttttttatgcgtaaatgtaatcgttttgcatgtaaatccattcgtcgttagctacctgttcatatagcaggttagctagctcacgagaaatattttgcttacttaattggttttgaataaaattgtattcattttgaaacgcactaatgaagagttcgtcttgaatccggttagcctgtttattattctgtaaacggcggtgacgttcgcggtaatagctttcaatccaatgaacttcagcttgattttcttcggtaatttggttgtgcaattcttctaggatccgggggatgattttagcttccacgttcgcaatgtcatctcgcgcaattttgattttacgtttaatggcttgattattaacgtgaaccgccttatgtcggagccggtgtttcaaacgaattaaggagtacttaattcggtataaaatttggtagaacagcgattgacgcagctggtagctttggaaaaggtcattcgttcgtacaaagtttgcaacttggagctaatttcgccctggtccaccatttcttgtaacagttgttcttctaagctgaagcacttttgcaacagtttaaaaatcattcgtctctttggacgctggaacatcgattcttggctttgcaaggttgcaatgaccgcttgggtttcaatcggatcttcgttagcgtccttaacctgttgaatagcgtaattaatcatttgctgccggtatttgctaatgtcgtcggcactatacgaaaccgtttttttaggtaagacgagtggcaaaataatgctaggcacgcatagactgaggacaattaccgtagcggcaataaaaattaggtcgttacgaaacggaaaagcggcctttttgaagaccaaagggattgagaaggccattgctagggtaatcgtcccgtgaatgccattgatggcgattaagaaacggttgagaagtcgttcttggggacgaatccggatgctagcaagtcgcaagctcacccaaacgtaacgaatcacgatcatggtgacgtacagcacgataccgatcaatactaaatccgttaacgaggccacctgacgactgttattaacaatgtcgtaaattacggtaggtagcgaaactcctaaaaggataaaaacaaaaccatttaatagttcgtttagattttcggtagtggtcttagaaacgatttgaatcttagtggaagttaagcgtaaaaatggggtttgcgtactttggactaacccggcggcaaccgcggctaaaattcctgaagtaccacaaagttcggcagctaaatagatggcgaagggcttgatcaagttaatggggacgacaatgttagcgtcgtcaatattagattcaatcagtaaaaattgaagtcgcagaaatgcccagccaattatccaaccaattatcaacccgcctaagaatacgtataagtagtcgaaaatgcttattaaaggtgaaaagtgcccagtttgaaaagcggtgagtgctaagtcaaaggccacgattccgctagcgtcgttaaaaagagattcattttttaggttaagcattgcgtccggggggatttctaagttgtcggttacggatgaaacggcaaccgcatcagttggggtgatgattgctgccaaggcaaatgctagtgcgagcgggatgtggggaagcattaagtaacttaggtaacccacacctaagatggtggttaaggctaaaccgacggctaacgagaacgtgtttccgagggttagctttaatttgttaatatcggtattggcaccgtcatgaaacatcagcggtgcaatgattgccagcatgaatatttcgggttccagaacaaagtgattaaagtttgggacaaatgatagcagcaaacccactaagatttgcacaattgctcgaggtaggaacttaattcgagaatccaaaatgttagcaacaataactgccaacattaaagttaaaatgaaaaataaaacgttcaatacgggtcctcctttctttgttttatgttaattagcgtaacaaaaaaacgcggaaaaatcgattttcgcgtttttattaatagtaatttagttatttactgaataagttagttaaatattccatgaaacgttgtagataacggtcggcgtctacgttaattgctacgttgacgttgggttctggatcggttaaacgagcaggatcaccaatggtacggccccacatggcgtcagtagtatctacaaacatgtttaaggccagcgtttgaactaggctaggatctaaggccacgccgactgctagcggatcgtggagcgcacagccgcctaagtgcggactggtaattttataaacatcaatgtagtagtcaacgatgtcagcaaatttctgtccggcgttggtgcctaaatcacgccattgttgggtttcttttttagtaagcaacgttcttagggtaacgtctaggccaaccatggtaaggttcttttgacgagtaaagacttcgttagccgcgtgcggatcttggttgatgttagcttcagccactggggacacattgcctggtacggtgagggcgcctcccattagcgttaccttgccaatcaagtccgtaatttccggatccttccgaattgcggccgcgaggttagtcagtggaccagtaggaactaagattaaatctgagttatattggtgggcagcttcgatcaggaagtcgatcccagattgttcttctaatttacgttgcggagtaggtaggtccacttcgccaatcccattttttccgtggatttgtgcgctaattggcattacttcaaaatggtcggttgtttgcgaatgttcatcgcccaagaaaacggggatgtcggtgtgcccgagcaattcgagaatttttaagctgttaattcctgcatcgggtgttagtacgttaccatatgtggaaataataccaatcaaatcgacgtctggagcagctaacgcgtaggcgatggccattgcgtcgtcaataccagtatcaagatctagaatcatttttttacttgccaaaagaacccctccgttaaataaacgtttatgtactgtattacagattaatcatacgaaactcgttgttaaaaaacaatgcttggctttcttttttgctgaagaaactgttaagatatttagtaaactaaaaaattattgtattaaagaggatgcagaaatcatgactgaaatatacgacattacgattgtggggggcggtcctgcgggtttgtttgccggattttacgcaggaatgcggactgcaaaaacgcagattattgaaagtttggcccaagtgggtggacaagcagctgctttatacccagaaaaagtaatttacgacgtgggcggttacgcaggcgtgaaggctgctgatttagcaaagtcattggaaaagcagactcgcttggttaacgtgccgatccggcttaacgaaacggttgtgaacattactcctaacggggaactatacgacgtggaaaccacgaaggcaaagtatcagtcgcgggcaattctgttggccaccggaaacggagcgttcaatccgcgtaaactagcggtgaagggccttgaaaaattggaaggtgacaagattttttaccacgttccggaattatctcagtttaaggaccaagacgtgttggttgctggcggcggagattccgcgattgacgtggcgttgatgttggagaaagtcgcacatcaagttagcctagttcaccggcgggaacaattccgcgggcttgaactaagtgtgcaaagattgaaggattcttcggtagaaatcctaacgccgtttttgattcatgacgtccgggaagaagccgcgggcgtagcggtggacttaaaggaagtcggcaccgaggagctaacgacccggaagtttaaccaagtagtggttaactacggatttacgtcgagcaataagattattaagcaatgggatgtagaattagaacaagcgcaccggatgttcgcggtggacaacttgatgaaaacaaatttgccgaatgtatatgcaattggtgatggaattgaatatcaaggaaaattaagattgatagccacggcgtttggagagggaccgattgcggtagatcaaattatgaaaaagttgtatccgggaaagaggggcccggtacatagtacgtcgatgtttaaatgatagagcgtgaaaaaaactgggtagctcttgaggactaacagaattaaggcattaatcgcggtttacgattgatgccttaatttagttagccggagagagctagtttttttcacgcgtttcgactacatagcagtagcacgccaggcactaattgcgggtttagcaattggtgccttaatttggttaaccggaggaagttggggccgaaaacacgtttcgactacctagcaacagaacacagaggcattaatcgcgggtttagcgattgatgccttaatttagttagccggagagagctggggatttccacgcgtttcgcctatctatcagtagaatgccaaaattaactaaatcaaaccacaaaaaaagaggattttcagttgcatcacgcaatgaaaatcctcttttaaattttaaaatcagctaccatttgaatccggattagtaatcttaattcgattttcactggttgacttatggtttacttcaggcgcgtcagttttataaaggtcttccaacgacttatcttgattacgcgaatacattgaagtagattttaattttagtttgtcctcaatcttgatagctttgtctaaaccgtcagaatagttgtaatctgcggaattgaccttcttaaagtcgggattcttgtaaaagcgtaaaaggttcttttcgttcaaggaatccgacatctctaattgtttatgggcggctttacgatccttcttgaccttctttaagaaagcatcgctaggatcggtaatctcgttaccgttttggtcgtacagggtgttgccaatcgaactatacgtaggcgtcacgaagtcgttgttgcggaacgctacgatttggctatgttgtttggacaacaagtcggtaccaaattggatatagttcttgtttgaaattcctagtaaatgaaggagggttggcaatacgtcaatttcgcccccatattggttttgaattccgccatctttcattcctgggatgtgaatcattaggggaacccgttgtaactgggcgttatcccaactattccagttttcggtgggattatcgccgaactgtttaaagtgatttggatcttgagcaaaagtcttcgctaaagctttgttagacgagttcgaaatcccataatggtcaccatacagcacaatcattgagttatcatacaatcccgatttctttaagaagttgaagaattcttcaatggactggtcgagatagttagcggttttgaagtaaccgtccacggttgcatcgccagtgtcgggagttttgaagtcgctgtcttctgcgtccaatgtgtacggaatgtgattacttacggtaatgtacttagcgtaaaacggctgttggagatgttgtaagtacttcactgagtctttaaacaacagcttatcttttagtccgtaagtagtcgatttatccccagaaacgtcaaagtcgctagcggagaagaagttttcataacccatgtttttataagtgttattgcggttccagaacgatgcggtatttccgtggaaaacggcggaagtatagttaccgtgctgttttaaaattgccggagccgcttggaaagtttggtacgaacctagttgggcaaacagggaaccttgcggggttccaaacgtactggtttccagcatgttttccgcgtcgctagtttttccttggcccacttggtggaagaaattgctgaaggaataggttgatttactatggtaaatactgtttaagaatggggttaccgtctgtccttcaaccttatcgtcaattaaaaactgttggaaactttctaaatgaataataatgacgtttttgcccttagccttcccaaaactaacgtcggatggcttagcatagtgttgtttaacatatttttcaatcgaggtaagctcactttttttagcttcggaacgcatcttaatgttgcgctccagttgaacgccgtcgtaagccgtaaaggcgtcaatgcccatgtatttaaccacgtaggaacggtcaaaagtccgggtgattaattggggacggtccatttcggcaagcatgaggttaaacgcaaagaataaaatccctaccgaagtaatttgaaaaccgaattttttcggtaacggatgggggtccatcttaatttttttcaagactaatagtaaaaagatgaccagtagatccaaccaataaaagatgtcgtgaaagttggttagcgacatggaactcgcgctaagtccttggtttaccttggaatatccgagcatcgtgttgacggtcataaaatcggaaaattcccgaaagtaaattacgtttaagtaaagtaaaattgtattagctaaatctaaaagcatcgccgtccagtaaaaagctcgtttaggacggacgtagagggctagcccgaagattagcatagtggtggcaatgggattgattaataaaatgatccactgaaaaataccggacactcctaaggaaatgtcggtaaagtaagcgaataaagtttttaaccaaaataagacgctgatcaggataaagaacccgaaccgcgtgtcaattcttgatttaagagatttcattttcaaagacctttcaaaagtacgttctttacaaatataaatgcaattttaccatagattgtttaaagaaatcttaaggggtcggtactaaagaaagaataaaataaaattttaataaattttcaaatctgtgaagaaattgttgtaagatgggcttaataatttggatttggaaaggaaggtcacgatggaagctaaaatggttaagggagcgactggcccaatttacatggacgcgttagcactccggcgacaagtttttgtggaggagcaggggattgatcccgcacttgaatttggtgctgatgaagatttttatacatactttgtgggctacgaagacgatacgccggtcgtgacggcacggactcggcggacggagcccaatacctggacagtacaacgggtggcaactgccaaggaatcgcggcgtcacggccttgcccaagaactttttgaatacattgaaacccaaggacgccaagcgggcattgaaaagatccggttacacgcccaagtaactgcggaacccttctactttgcgttgaattacgagcgcactggcggtccagaaatggaagcgggcctattacattactggatggagaaaaaactctaatgcgttggaaatctcaaattgggttaatattggtagttatattgactggcctactcgtggtgggcttagtacagcatgacgacgtgatttaccggaccccgttaggtcgaattgaacgggttactaatttaaaaaaggttccgcaaaccgacaattttaataatcacgattatcgtgccaagcaacgtctccagattaaaattttaaacggaaaacaccgggggcaaacggtgtccgtgaagaacgaatatagtggttcccaagcgaccgatttaaaatatcggccgggccaaacggtactgttacattttaatggcaccgggcagcgggtgaagggagcgacgatattagatttgaagcgggacgtcgccatcacgatattggtagtgattgccgtagggctgttgattttaatgcggcgaaccggaattcacgcaattgtcagtgtgttattaaacatggtgctcttttttattgccgtggaaattgacgtgcaagaatctggatatgcagtattggaaatttttagcgtggtcgcggtgttgtttagcgccatcacccttaccttagttttaggctggaacaagaaaatgatggttagtctgttaacgactttagcaggaacctttagcgcaatgttgattggcggacttgtatttagtttgacgggcaacggtgggcttcattttgaaaccatggagtacgtgacccaaaatcccgaaccgctctttttagcagaaacggtgctaggttcgttaggggccgtaatggatgagtctaccgacatcattgtcagtttggctaagctgcgaaaggaaaacccgcagatttcaatgaaacagctgtggatttcgggacggaacatcggtaaaaccattatgggtccccttttaaacgtgttgttcatgatttttatggccgacaccttttccatgatggtgctttatttacgcaacgggaacagttggcagtacgcctttgaaatgaacatgcagttaggttttgtgcaaagcttaatcagtggaattggaatcgtgttgacggtaccgattgcaagttggctgacgggcgtctttttcaaaaataagggggtaccgactaatggttagcgcgacgttaattttaatgatcatcttggcggttctaatggttatcgtggggggagcgaccggattgcgggcctttttaagcattattttgaattttgcggtattgttcgtaaacattgctttaatttcgtggggctttccggcgttgacggtgaccattatcagcagtttggtgattttagccattacaattttcatgggcagtgacgacgaccagattacacagaatgcattttacagttcggtattagtattggtagttttgattgggctgattctgattattcatccccacttaatgattcaaggattcggtaatgaaaacaacgaggacctcgaagggatgtcgttgttgattggaattaagtttagtgacgtaattacgtcgacaatgatcattagttcgttgggggcggttgcggaagcttcgattgccgtatcgacggggattcaggaactgattgaaacaacgccggatttagatttgaccaagctttttagtcacggctacgaaattggaaaagaaattatcgggactgctttgaacaccttattttttggcttctttggaagttttctgggtttatttatttggtacgtgaagttgaattaccgctttagcgaattctttaataataagatttttgcggcagaattttcgatgattttgattggtttcatcggggtaattagcacggtgccgttgacggcatgggtaacgcaattaagagtgcgaaaaaacttgggtagtctttgaggactaacagaattaaggcattaatcgcggtttgagcgattgatgccttaatttggttagccggagaagactgagtttttttgcacgtttcgacaaggtagcaaagaagcgtcactgaattacgggactaattgcgggtttagcaattggtcccgtaatttggttagccggagaagactgagttttttgcacgtttcggcaggcaacagcaaactataataaaaaatacagtatttcaagccggtgcggttttactcaatgccggtttgaaatgctgtatttttgtgggatcattttttaaaaaagttactccagttaacgattagataaacaattagaattaataggaacgaaatttctagggtaacgagccaactccagccttgatcggcaagcggtaatttaacgttttgaccgaagaaaccaaaaacaatgttaggaactgctaaaacaattgaaagaattgtcaggaatttcatggtattattcaagttattgtctaaaatatccgaataggatttagaaacttgttcgataatgtctgaagatagctgggccatttcttgactctgctctgattcaataatgatctcctccagccgattccgttgggccttggtcaggtttaggttggggagacgcatcatgctgttaagcaacgacgtattcgactttagagaagtcagtaagtagattaaactggtttctaattgcaacatgctttggatgccgctgtggttcaggcgggttttaaatttatcctgaatggcctgacgatcataattaattcgggagaccgcgtcgttaaaccgcatcgtaagttcgtaaatcgtgttgaaaacggcgttaaccatcagcgaactatttaactgaaccggtttatttaaagttttgcgtaataaagtttttaaattgcgatccataattttattaacgtagtgggtagaatcgtgagtaaaaattaccagcgccttaggtagaaacagaaaagcggccggttcggtctgaataccggcattatatagcgagcttaaagcatggaaaataatcaaaaagctgttattttcttcgtcaatttctgcccgagcacgttcgttagggtcaattgcgtaactcaacgtttcggaagtggcgtggtaagtttttactagggtctgtaattctaaagtactcgggttcgagacttgaattagcgaaaaatcattcacggttttgcttacttttaacataatctggacctcgttgtttgtattaacctaagtgtaacccttaatgggtgaaaaaatatactaaatcgattaaaatatattatttggagtttaaggggagaaatttatattgaatattttaacaaatttatacggtcccttcttcgatctcaacaattggaagacggtattagagtctagttcggactggttagtgattttatcactggtgatgatcgaatgtttactatcggtggataatgccgtagttcttgcaacccaaacccaagtgttgggagataaggtcgaacgggaaaaatccttattttacggtttgtggggcgcgtacctatttcggtttttagtaatcgggattgggacttacctcattcacctatgggaaattaaaatcattggagcactttatctagcatacctagtgtttcgctattttgacaaacggaaacgggggcggcggactcgtaaattggtgaagccacggggtaaaatttcgcttttttggcgggtggtaattcaaatcgaatttatggacattgtcttttcaatcgattcggtattggcttcgctggcgatttcttctaatccggtcattgtgttactggggggcttaattggaattttagcgatgcggggaattgccgaggtgattatgaaattaatgcaccggattcctgaactagagacaatggcctacgtgctgattgggattattgcccttaaactattcttgtcgattcccgcgattgatattgaaattaattcgggaatttttgccggaatcgtagtgctggcattcttgattacgatcgcaattcactacctcagaaaaagcgtacgcaaataatgctataatctatatactataaataaaaaggagactcctcatggcagctacggtaacaagtgaaaatttagctgaagtaactaaagatggattgaccatcgttgatttctgggccccttggtgcggaccctgcaagatgatggaacctattttagaaaatctggagcaaagttacggggaccaagttcattttggcaagcttaacgttgaccataaccaagaattggcccaatcgtttaaggtaatgagtattccttcattagttttgtttaaggacggcaaggcaatcgaaaaggttaccggcgtttatcccgaagcaaaattagcgaaatatatagagaagaagattaatgaaaatgaatcaaagtaaaacggcaattgtgatcgatagttcggctaaccttgatcctgcgatagcgcggaagtacaacattacggtggttaaccagccaattatgtttggcaagcacgtctatcacgaaaatgttgatattgatgcggatgaattttatcgcatgttgaaattagaaaagtaccatcccaccacttcgcagattccgattaaggaaatgcaaagggtttttgctgaacttgctgcgaaaggttataaagcagccttgtgcatcgggttgtcgggaggcttgagcgggttcattaatagtctttcagcttccgtgccggtaattaaggagctacaagtttacccttatgattcgggctcaattctggctggacaaagcaatgcggccattttggcggccaacctgttagatagtggcgtggacatccacgaagttttgcggcagttgcgtaagtatcgtagtcaaacggaagtgtacttagcggtcaacaacgttaaagaacttcagatttcggggaacattgccagtcggacttcgttggtaagctcgttttttgggatgcgcccaattttaacgattaatcggcaaggccgcttagaaatggtcggtaaagagcgtaagataaaaaacgctatggaagcgattagtgaaatttttgcgcaacaagtggttgattatcgccatttgacggtgacggtggtcgatgctgatgatgcagatcgtagcatgcaatggcaaagtgaactgaaggtccaatacccgggcttacacgtagaatcttgtccaattggtccgtacgtgggaacctatacgggaagcaaggcaattgggttaatttggtcaccaaagttgtgataccatagtagttaggttaattaagaaacgggtggataaaatgattacattgaaatcagaacgtgaaattgaaggaatgcggaaagcaggcgcagttctagcaggaatgcatattggacttcgcgatgttattaagccaggaatttctagctgggacatcgagaaattcgcgcttcgttatttagatgaacacggcgcagttcctgaagaaaagggctttgaaggttacgaatacgcaacttgcgtgagcgttaacaacgaagtatgtcacggttttccgcggaaagatttgattttaaaggaaggcgacttagttaaggttgataccgtagtcagcgtggatggttacatggcagattcttgctgggcgtttgcggttggtgaagttagtgatgaagttaagaaattaatggaagttactaagaaagctttgtacctcggaattgatcaagccgttgaaggaaaccggatcggcgacatcggtcacgcaatccaaacttacgtagaagacgaaatgggttatggcgacgtccgggaatttgttgggcacggtattcaaccaacaatgcacgaagatcccatggttcctggctatggtgaagctggtcacggtccgcggctccggaacggaatgaccatcactattgaaccaatggtgaataccggaagttggcaatgtgatacttctgctccagacggttggacagttaccaccatggacggcagtttatcttgccaatacgaacacactttagtggttacgccagatggtcctaagattttaacttcacaggatccagtgggggacgctaagtacctttaatgaaaatgattaattattaataaaagaggctgggaatttggcgttcccagcctctatttttgtaatatgggtgtggatctgttgggttgtgagatagtcgagacgtgttccagccctcagagttctgcggataaccagattgggtccttaaccgcaggacccacagttagaggaacatgttctactgtgagatagccaaaacgtgcactaagcccccaactctctgcggttaaccaaattaattcatcaatcgctaaacccacgattaatgaattaattccgttaatcctcaagagctgaccgggggcttggtgcactctgatttaataattcgccacttccaccacatttccgtccgggtcctttatcaacagcgactggacctttccgtgagttccctggcgttgctttggttcatcgacaatttccacaaagtagctctttaagtggttgacaatttcgttcatcggatttttggcaaccagtgacaacgcaatgcttccggaggttggttgcgctggagcaattgccggctgggtctccttagttgtaaaatagattcgctgcttccccgcacgcacacctggatacggagcgtcggttaggatcggcatatcaaaaacctcgtggtaaaaacgttcactacgagcaacgtctgccacggttagggtaatatgatcaatttctcgaatattcataatctataaatcctccttgtaacctgtacaagtatagcataggtaaattcaattgacgttttgtggtaattcatgctacggtggttactagttattttaaaaagacagggtgaaaaaaatgagtttgctatcagttgaacatctgagccacggctttgcggacaaagaactgtatgaagatgcaagtttcgaactgaataaagaagatcacatgggaattgtcgggcaaaatggtgctggtaaaagtacgctaattaagattttgactggcgaaactttaccagataagggccggattgtttggcaaaacaaggtcacttacggttatttagaccagtatgcggatattccgcaaaatgacacgttgtacgaatttttaaccactgcgtacgcagatttgtttaagcaacgtgatttaatggaaaaatactatgccgaatacgccgaaaatttggatgataagttgttggaaaaggcggggcggatccaagaaaatctggacgctaacaatttttacgaaatcgataccgaaattaaccgggtaatgaccggtttaggacttgatgatatcggtaaggattacattgtcagcgagatgagtgggggccagcgttccaaaatcattttggcaaagctcctactacaagatcctgacgtattgatcctagacgaaccgaccaactatttggataccgcgcacattaattggttggcagactaccttaatggcttcgagggagctttcatggtagtttctcacgactatgagtttttgcaaaaggtaaccaattgtatttgtgacgtttcatttaacaaaattactaagtaccggggcgatttccaatccgcaatgcgacaaaaggaagcgcggcaagaagcacaattaaaggcttacgaaaagcaacaagtagtcattgaaaaggcggaaaactttatccgcaagaataaggctggccaacgttcaacaatggcgaaatcccgggaaaagatgcttaatcggatggacaagatcgatccgcctagtgaaaacttgaagggacatttcgattttccttacctagatacgggctcacaaaacgccgtagcggttaataagctagccgttggttatggtaaaaagcagcttttggaaccagtgacgttctccatggtggcgggtgaaaaggtggccttctccgggtttaacggagccggtaagtcgacgttaattaagagtatcttaggtttaattccggctttaggaggggaagctcatttctcaccatcagctaaggtgaactattttagccaagaattagtttgggataaccccgacctaacaccattacaaacgattcaagaaaaatatccgaccatgttaccaaaaacgattcggactaagttagctaagtgcgggattaacgcggcggacacccaaaagcccatgcaccaactaagtggtggcgagcaaactaaagttaagttagccttgatggaattgattgaatctaacttcttgatcatggacgaacccaccaaccaccttgatgatgaaaccaagcaagccctaagtgaagctttgcaacgctttaaaggaaacttaatcgtggtatctcacgaaagtagtttttataacggctggattgataaagtgatcaacgtggaaaaattacgtttggatcgctaaaacttaattacaaccaaaagggttgtgtcaaaagactttaaacaaaaaacgggttctacaatatctgttgttggtaatagaattatctattgctgatgacagatttttttgtattcttagatatataaaaaaacggacactcactgtccgttcagaaaaaatcaaccacgacgaagattctcagaaagaagtgaatgtccttatgtgtaatgatactaccaatcttttgttaggtatagatgataatcatataaaaattaaaaatggtgctcgaaaatgtgatggagttattcgcttggaaggcactttagactacaagccgatggcttgtcccaaatgtggcattatgaataatggacagattattaggtatgggtggcggttgaccaccgttcgctttgctaaagctcttggaaatgataccgtcttgaagttaaagcgcagatactttcgctgtaaagaatgccaaactaattttctggcgcaaactaatctagttcccaagcactgcacaatttctaatccaacacgtaaagcttgcttagaaaatcttgctgaaccagtgtctttaaaacatattgctaatgagctctcgacatctgactcctttgttggacgacaactattacgagctgaacgcgattttaaaccaaactttcactggcttccggaggtaattttaatggatgaaatcaaaagtactaaaaccgctaccgatgctatgagtttcgaattcatggacgccaaaactcataaattaattgatattcttccatttcgaacgatccaacggctggaaaaatactttaagcgttatgaccaagcagccagagaaaatgtcaaaatcattgtcacagatatgaactatacttaccgaagctgacaagaactatctttccaaatgcgattgtcgtcgtagataagttccatatcgtcaacgcccttaatcgggcgtttaataagactagagttcgcataacgaaaaaaattgccccatcttcccgtgaatttaaagcacttaaacgctattggaaattattgctggtgcctcatgaacagttagattttgaacgatttcgtaaatggacctatttcccttactgggtcaccgccaaagatattgtagatcggttgttaaatctggatcccgtcctcaagcaaacttacgatgtcttaaataaacttcagaccgcacttaaacacaaagattggaacaattacaatgccgccttttggaacaccgaaggttgttctgaagaaatgcttagtacacttaaaatgcttcaaactcatcatgatgaaatccataataccttcagtacacaacactcaaatggacctttagaaggattaaataataaaatcaaagctatcaaaagagctggttttggctaccgaagtttttttaagtttaggattagagtactttacgttttccgcgtacatactaaaaaagccctaatcaccaagtgattagaactttcaaaatttaattcaccaacaacagttgacgaagagccaaaaaacggttcatgaggtgaaacttcctcatgaatcgtttttattttggcgttttgatttcaatagagccaaaacgtgtgccaaaagtcagtttgttccactctctttgtttagcgattagtaatattaattagaacgttgctgtatcgggatcggttggggcacctgcttggccgtggaaaccatcaatggttttcatgtcgtcagcagatagttcgaagtcgaatacttcggtattttgttgaattcgatccgcgtggacagactttggtaatggcaagaagccgtgttgcaatgaccaacgaataactacttgggccaccgacttgtggtacttttcagcaatttccttaagttctggaatgctgaagattttaccagttcctagtgggctgtaagcttcggaaaggatgccgtgttctttgttataagcaaccacttcgtcttcagtatcgctaggattgaggaaaatttggttaactgcgggagttaccttagcagtcttcaacaattcgtctaggtgatgaggccggaagttggaaaccccaattgcccgcactttgccggcttctagggcttcttccattgcccgccaagattctgcgttcttttgttgccattcgtcacggaatttaacgggatttggccagtgaattaagtagaggtcgaggtagtctaaaccaagtttttgcaaacttaaatcaagggcttttttcgttgcttcgtaaccgtggtcttcgttccatagcttagaggtgacaaagaggtcttcgcgagctacgccactgtctttaatggcttttcccacgctttcttcgttaccgtaagctgcggcagtatcgatatgacggtatccagcatctagggcagccttaactgcttggtatgcttcttcaccatctttagattgccaagttccaaaaccgattacgggaatcttaaccccgttatttaaagtataggtatcggtgagtttattcatgagaaattcctcctttatttaaccttacttactatatgatagcttttttctttagcaataaccagccataagcccgaaaatttgtcaggcgttttgtaaagaaaagggtggccgagataaaaaaataggggctaggagcaatcctaacctctattttgaaatctattatttattaaaagtgcctgcttctacttcgcgaaggtaatcagcaagatgcttgaagtaaacgggggcgttgtcgatcatgtggtggtgaccgccatctggagtagtaactaacttagcgttagggattacttcagccatccgttgtgccgacttcaacggcatggtttcgtgttcgccgaaggtcaacaaggttgggaccttgatgttatggatttggtcgcgaacgtcccattccttcaacttaccagtaacaacgaattcgttgtcgccttggaaagcattgtaaacgggagttgccatagttggaaccaagtgacggattgccactggttgtttacgatctacgtaaccagcgttaagtacgtcgactagtttttggtaacgttcgttatcccaatctccagacttttcacagtcacgcatgaactgagcatcttcgggagcaagggcttcgtcgcgaattgcgtcttgatgttcgaggtattcatcgatattatcaaccatggaagagatgatggcaccctttaagtgttcaccatacttcaatgcgtacatcatggtcaatgcgccaccccaagattgaccgatcaagtagaagtggtcaatgccgagtttttgacgaacttcttccacttcgtcaaggaagtagtcgtagctgaggtacttttcagcaatttcagggtcggagtagtcgggttggtcagaataccacgaacccaattggtcgtagtagtgaacttgaacgtccaaaccttgttttaaaagttcatcgtggaagttttcccagtattcgtgattgccaccgggaccaccatgaagggccaaaaggtggatggagtcgttagtcccatccgtatgtgaccataagtgatatccgttatctagtgttaaaattgttgtaccttgtttcaagatatttcacctagtttcttaaatttaagcctataatagcagatttattagaaagtgaccagattaaatgagaagcgtttaggcgtaaagttccgcggaaatactggtataaccgacttagtgcttaaattaaaaaattagaaaaaattaattattttctgcagttgattaaggagtaattttaatgcaaattaatgtcgcacgactacaaaatgaatttccggatgaaaaaattgaatattttgaccaagttggctctactaatgacgtagcttttacgcgcgtgcaacaaaatcctggaatagcggggatggtagttgccaatcaacaaacggctggacgagggactaaccagcgccagttttattcaccgacttcggggatttactgttcgatttaccttcctctagccccagcaaccgttttacatcccggacgggtaacggcaaacgtgggcgtgattgttgccgaagcggtgtaccgcgtttttggacaaccgcttggtattaaatgggtgaacgatttatatttacatgatcaaaaggtgggcggcattctgtgcgaagccgtgtctaatgatgataatcaactaatcgggctggtgctgggaatggggttgaacatcttaaccacgacctttccccaagcgatgttgcggacgggagggccgattgccgaacaagcaaacgcaacgcaagtaaccgacctgttgattaagatcaaccaagctatccaaaaaaagcgccagacactggcgtctgacgcaattaatccaaagtatttagatttatcgattttacaagaccaatgggtgatcattgatcaggctgcaagtcggcttaccggaaaagtaacggggatcacacccgaaaacgaactggtaattaacgatggtcatcagctccgaaccgttacgaacggtcgaatattacgttggcaagtcgaacctttaaatgactttgattaagctgcaatgaatattgcaaatcctggttgccccggatggtggtttcaaaatcagttgcgtaaattaccaatcctaattggtgacctgcaggaaggtgatagaacgtcggctgtaactgtaaagttacgtcgtagaattggttaggcacgactttatcaacgcgatagttgttagttcgattttgcaaattaatgtggcctttactaatcattttccacggggtgacgttcttttgttgcgtaaattcccgtaagtcgtcggtgcgccaatcgtaactgccacttaacgagcgaggttggatgaggcttggggtgacgtttaagcgccgggcatcgccaaagtcaactagttgaaaactaagcattccaaatggtttattaaccgccacgttaaccttaacttccgcagctccatcaatataccaatcgtgatcgagttgggcagacttgaagattaaccggttatcacgcatctggtttttaccattggtggcgtgttccgtgttaagcaggtcggtatgccactgcgtaaggttatttttgtacatttcaaaaacttctggatcgaggacgtctttaaacgaggcggcctcgtttttagttggcaaagcagcgtccaccagtgttttggcttggagggtgaattcccgtacttcatcatcagcatcctgccaatcagggtaggtatgccacgtttcgggttctacgttatcttgaatgatgacgtttggtaaaacttctggagcattattttccacgccgaacaacttgtaacttagccataagttcatcatgtcggtaaagtcaatcgaacggaaattattaatgtaaatgtgctgaccttggtgaagaataatcttcttgttaattggcaagtcacggaccgcgttccacaagttagcgacgttacggggcttgacgttccaatcgttcaaaccgtgcactaaaattagatcggccttaatatttttggcttggttgagatagttgcggctgtcccagtagcgagaatagttgccgctttgccggtcttggtcgtggttaattcggtttaaaacttggtcaaatttactacgaacttttaaagcatccccaaggtctttttgtcgactaaagacttcggcagcgaggacgtccatgtcttcaccctggaaggtgtccggagcggcaactaaaccgccatcccgataataatcgtaccaactggaaatggccgcttccaaaataatggtttcaagaccttcaaccccggtagtagctgctgcagtggctaacgtacctaagtaggaacgtccggtcatggcaattttatggttactccagttggccttgatttcaatgttatcggttttgttagtaaacgcgcgacgattttccgcgagccattcaataattgccgtggtggaaatggtttccgccaccgaaccagtatcccgcaaaccttctgaatcccgggttccgattccggccgcataaactaccgcaaacccacgggttaggaagtagttatttaaggtgtagggttgttcgcgggcaaagtgttcgcaagcgtgttcagcttgacccttaacttgtcgttcgggtggcagttctgggtcatacggtttagccgtcacgtcttcgcgagtaaggtggttaactggtttttcagttaatgggacgtcgacattatgggttacttgttcaccccaatgatcgttagttccttggttataggggctggcagtatacaaaacgggggccttgtatccttgttcagtttgggcaggacgtaaaatttctgcttttaacaggtcgcgtttgccatcgtgatcagtatctaagggagcttctacgtaaacgacttctcgaatgatttgatgcggatcaaagacggcttgggcctttccgttgaagaataacggggcggttgtggtcgcgtagaacggggtgaagtagccttgttgggtaaggtgatcaaggtaagtttccccatttttcgtgtgcgccgtcaagattgaataccaagcgtgtgccacgtctgcgctagtttcaagagcatcaagggcaaggcgcggtaagttgattttggcagttgcagcctgtgggtcaataacggaaaaatcaattcctgattcaaattgtaatagctgtaaggcaattaaataaaaaatatccagggttagcggctctgcgctcgcaaaaaagtctgctgcagtttggttaggcgtcgcaagtaggttgcctaacttttgttgaaacgtggactcttgattgctgattaaaaaagaacgccggagaaaatcctcaaattgtgccttaggatcggcaatcaggtcctggtcaataaaatgaattgctttcaattcggtaatttcttcatcttggtcaacgtcaatgcgaccaaattggttgtttttcataaaaaatcctccacagtggtttatggttcatattatacgccttactgataaaacagctaatttaggaagcttacaggcccttaagagccaaaaagtttacttaatgctaattttttataaaaataatgcaaaaaaatatccattttatagctaaacacgaactataaaggttgataaataaaataaagtatggaataatcagcttgtaaataaaacaatttatcacacggagggtcaaatcgtggaacaaaacttaaaggaagtctcatcattggggattttggataaaacgtttcatctgagtgaaaatcaaaccactgtgaagcgggaagttttagcagggttaacaacgtttgtttcgatggcgtatattttatttgtaaatcctagtattttgggacaggctgggatggataagggagcggtattcactgcaacggcactttccgcaattattggatgtgtactaatggcatttttggctaattatccaatcgcggtcgcgcctggtttgggagataatgccttttttaccttttctgtggttttagggatgggaattccgtggcctaaggcgatggctggagtatttattgcttcggtactatttacgattctttctttggtgaaagttcgtgaaatggtgattgacgcaatctcgcaagacttaaaactagcaatggctgctggaattggtattttcattgcgttcattggtttacaaggtggaggactagtcacggctagtaagacgtccttagttgaaatgggttcattgtctgtaccaacgacttggctaacaatttttggtgtgtttgtaatcgcaattttaatggcacgtaaagttcctggctcaatttttattggtttagtagcaactgcattgttaggtttaattacgggtttgattaaaatgccaactagcattgtttcacttgctcctagtatgaaaccaacctttggagtaggaattcataatttgccttcaatccttgacccacaaatgtgggcagttgtgctgattttgttattagttgctttcttcgataccgcagggacattaattggattagcacaacaagctggaattatgaaaaataataagatgcctagaattggacaagccctcatggcagactcattttcaatgcttgccggttctgtaatgggaacaacgcctgcttcagcttacgtagaatcttcagcaggaattgctgtgggaggtaaaactgggttaacttcattaactgtaggaatactctttgtcttcagcatgctattttcaccactattaacggtagttactacacaggttacggctccagcgctaattattgttggagtattgatggcttcagcattaagagagattcaatgggataaatttgaaattgcaatgccagcattcttaacaattatcggcatgccattaacgtataatatttcttatggaatggcatttggttttctgacctatccaattctcatgaccgtagcaggacggcgcaaggaagttaattatattgtatggatattaatgtttgccttcgtgttaatgctttacgtgctgaatatgttacctaagtaattaaagcaattaaaaaacaggctatactcttaaaattaggagtatagcctgttttttttatctatataaattattcagccagtttactatgccgcatcccatagctaaagtaaatgattaagccgattgcaaaccagattgccgaaccaatccaagtctctaaggaaagggtcgaaatcaagtaaacacaggcgataactgaaatgatcggaatcactggataaccaggtaccttaaagccgttccccgggatgtcggtgcggcgacgaagggggattacccctagcgagattagtccgaaggcaaacagggttcccatgtttactaggttggtaagttgatcaaggggcacgaatccgccaagtaacgcgataaaaatcgtaacgacgatcaaagcgtttttgggtgaacggtgcggcccttctagttggcctaacaagcgtggcaggagtccgtcccgcccggttgcgtaaactaaacgagaactaccgtaaatcatggaaatcatcatggtggtcatccctgctagggcacctacggatagcaatcccgcaatccagttctggtgaactaattgtaaagcaaaggatacggggtttgctacgttaagctcgttataaggcaccatcccagttagtaccactgccaccgccacgtaaaagatggtggcaacgatcagcgtaccgataattccaataggcatgttcttagccggattttttacttccgctgcagatgctgaaacggtgtcgaagcctaaataagcaaagaagacggtggatgcgccagctaaggttccatgaatcccaaatggaaagtatggttgccagttgctgggtttaacgtaaaaaatacccacgccgataaaaattaaaataattgcaattttaacgaaaaccattaagttgttaatgcggattgaagacttaaaaccacggtttaatagaaagccaattaaaagcacaatgattaccgcaaacaaattaatataagtcccatgctggggatcaaatggcccggcaattgctgcagggaggtggccaccaaatcccttaactaaggaaccaaagtaagcagaccacccggtggaaaccgccgcgacggccagtacgtactctagaattaacgcccaacctaataaccagccgagcagttccccgtaaataatggttccgtaggagtaggcgctgcccgctacgggaatcgaggcggcaaactctgcgtaacacattcctgctagagcacaaaccaaggcggcaatcacaaatgatagggtgattgagggaccagcttttagcgccgctacggtgccagggagaatgaaaattccggtaccgattactgccccgattccgagggctaagaggtctttagcgcccagcgttttttcaaattgagaatctaccttcagataattagctagtgattctttacgaaaaatattatgttttagttgcatacgccacttcctctctaatgtttttctaataatacgggatgaagttaatactgtcaacgaaaatcaagaaatccacctagattaaatttgctaaactagtgcaattagagactggtataattaaaaaagtaagcaaaaaaacggaggaatgacgatggctttagaattggatggcggagcagtagtttaccaaatgcgggcaaaagagccgtattacttattgctaaaaagcgctacgagcggtttttggggattccctaaaggacatttagaaaatacggaatcggctcttgaagccgccgagcgggagattagggaggagaccgggattatcgctacggtcgacgatcgtttttacgacgttttaaattatcgagttggcgaaaacgacaagaaagtgaccctatttacggcaaaagttcctgaagatacggtagttcgattgcagaaggaagaaattagcatggcggcgtggcttgattacgcagctgctagaaagcggctaacctacctaaacttaaagcaggcgttagataacgcggaccaatatattcggaaagcagaacaatagtaataaaaattgggcgcgcgcaaagcaaacaaaaaagaggccatgacatcgcgggtcatggcctccttacttgcatttgataaagctttttaagagttaagttatgctaacttgctgaatgaattttcttcgaggctttgaagattttgaattgcttcttcaatcgttacgcctgtagcttgaaactctggttgggctttatcattagcgataaaaacctgcttttcagtatcaagtgcgatactgtaccaagctgtgctgtactttttaaattgcataatgataaacctcctaaatcatgaattttagaagcgggaaaagcgcttccaattgatacgataccttaatttacaacattttaaacaaaaatgcaaatatttaagcttggagtaagggaaatgaataagattattgtaatagcggggcctacgggttcgggaaaaaccacggtagcagactatctcaaccaacgttatggcgttgtgaaggtgatcacgcacaccacccgcccccaaaggactaatgaaaagcaaggggtggactattattttgaaacggcggattcgttcgaccaaaatcattatttggaacaagttcagtacgctcactaccggtacggctcttcctacgaagggctcacccaggcgtggcaaaagaatccgattgcttgcattgtgttagacacggccggggcaattacttaccagcaaaaattgggtgaccaagtggaaattttgtttttgcgggtgcaaaaagaagctacgctgaaacaaaggctgttgaagcgtggggatagtatggattcaatcactaaaagaattaacagccctgagtatcgccgagatatggaattgccaagtgaactacaaggaaaggcaaccgtgattgataacgacgattggcaggctactaagcaaaaacttgatgcgttttatttgcaggtcaaaaagcaaactttggacgtttaaatgcgcccctaaatatgttaatgtaaagcgtaataattactatttacgaggtggcaaactgtggataaaagcccaattgcaattgcggttaaaattttaaaagcgaacggctataaaattacgcgtcagcggcagagtttattagagttgcttgcgcaaagcggtgatcggtatttggaattaaccgaattagaccgcttgatgcggctacaatttcctaagatgagtcataacacgatttaccgaaacgttaaggaatttgcggcactaggaattgtggaagaaaatcaaaacgaaaatgacggaaaaacagaagtaaaactggactgtaacgagcagcatgcacatcaccatcactttatttgcaaccagtgtggaaaagtgcaggaattaaaaatgtgtccgttgagtttttttagtgaccagttaccgggtgctgagattaccggacaccattttgagttatatgggatctgtgctgagtgtgcaaaaaaagttcacgcatagtgtggataagttaaatgttaactttatcagataaaatattaaagttattgcaaacttgggggagttttgcttacctgagcgcgtttttttggtatgctaacgtttggaaatatggagggagatagaatggcatacagaacaccaccttttttaacgccgattgccatcgcgacgatgataattgcgctaagtgcgacaaacgtaattgttaataaagctaccaacacttctgaaggagcgccggtgcgttcttcaaaagtagttgaaagcagtgaaccagaaaagaaaccttcaagcgacgatgaacattctaaagataaatcggaagagtcgtcatcgagttctgaagaaagcagcaagccgagtgaagatacttcaagcagtggggaaacttcacaaccaactgatgatcaaactcaagacaattcttcttcgacaacgactaaggattcgactggcaatgataaggcctctagtggggcaaatgatgaggaccagaccacgacggatagttccggagatgcaagttcaggatcgggagctgctgcatcgcaaggacaagcaagtttgcagcaggatactaaccaacaggctgccgtccaaaaggccacgaccactgatactaatacaggtcaataaggggggataaacgtgatttcatttctaacattagtaagtcattacatgggcatgattagtgttaagagtaagttgaagaaccaaatttacaccatcacagcctttgtagggaattggtatttgttatacattgggattcgctttatccaaaatggcgcatatacaagaggattactgctattagcaatttttttgatcttcttgtatttctcaattatgaacatttattactatttcactaataagcaggctccgtttgatatttctccaattttagaaaaatacattgggggtacgccagaagaagtgcgggaaaaagaagaattccggcgtcgcctttcgcgggtagaacgacaaagccgccaagttgctagtccaggtggagttttcgaccagaaggccctgttacccgccacgatcgtttcatctgcgcgccaacaaaaaaatattgaacaaattgcggaaaagatgattcaatcagggatggtcttcatggattatgggggccggactgacgaagaattacgggcagaaatgcctgctcagcaaaccgaaacgtacgcaatcggcgacttgggagtggcgatcccgtatgcggaagtccaactcgttgctggcaaacccactgtgatagctggaatgaaccaaatggaggccgttccagtgggcgaaattaccaaggtgggcttatccagttaccaagccgctaaagctgaaaaccacttgtatttagcaaacgcgtttttaattggtggcgaaaagaaagtacgcggtcgctctggaatgatcgtggaaaatgaaccataccgcttaaaaattaatattgcttataaacggcgccaaacctcactttcgaagtgatttgatgataaattattaagacctgtcaatgtatttactttgacaggtctttttttgtccagtatagtcaatataaccaaaaatttatctaattttaatctttcgttaatgtaatcgggtaaatggaaacggagggatcaagatgtcgatgatcgaatttcataatgtggaaaagtattacggtaagtttcatgccctaaccgacgttaatctaacgatcgaaaagggagagacggtggtattgattggaccgtctggttcaggaaaaagcaccttgattcgaaccattaacggattagaaagtattgacggtggtcaattaattgtcaacggatttgacttggccaaccgccaaaccaatatcaacaaaattcgccgagaagtgggaatggttttccaacattttaacttgtatgataacaagtctgttttagagaacattatgctagctccccgggtcgtgcttaaacgacctgaagaacagaatcgccaactagcaatggaactgctggatcgggttggactagctgaaaaggcagacagcatgcctgccatgttatcaggggggcaaaaacaacgcattgcgattgcccgtagtttagcgatgcagcctaaatgtattttatttgatgagccaacgtccgcgctcgatcctgaaatgatcgatgatgtcttaaacgttatgaaacaaattgcccgcgattccgccatgaccatggtagtggtgactcacgaaatgggctttgctcgtgaagtgggggaccgggtgattttcatggatggtggtcgaattctcgaagatgatcgcaaggaagagttctttgacggacaaccatctaacgaacgggcacgccaatttctcagcaagattatcaaacactaggaggtggtccccatgcgtagaaggtttaaaatgcttttcttgggactgacagccgtactttttctgggcattctaggtggttgtacaaagcaagaagctaaacaacgtgacgcttggcaaaccgcccagcaaactaaaaccctcacttggggggtaaaggccgataccaagttgtttggattaatggacgtaaaggactcccaaattaaggggtttgatattgacattgctaaagcgctgacgaagcagatgttgggaaaggatgcgcaggccaagtttgttcaagtaactagccaaacacggattccactgctgaagaatggcaatttggatgcagtgattgcgacgatgacgatcactaaggaccggcaaaaagtagttgatttttcagactcctattttgatgccggacaatccctgttagttcctaaagatagtaagattcatagcgtaaaggatctaaaccattcgggtaccaaggtgattggggtagttggtgctaattcggtcagcaacgttaaaaaagttgcccctaaagcacaggtaattcagttgcaagactatgctcaagcgcttacggcactaaaatccgggcagggagcggctttaactacggataacggtattttatttgggatggcggttgataatccccaatttaaagtggtcggaaaggcgttcactaaggaaccttacggaattgccattaaccaaaaccaaccggcgttgaaaaaacaccttaaccaagcgttggaagaaattatcgcaaacggggagtataaccgactcatcaagaaatggtttggcgatattcctggatttaattaccgggaggtggaacgatgattaatattttaactaatcatagtgcggagctctttagcggactcggacagacgctactttgtagtttgattgcgttattttttagtttagtaatcggatcactgtttgccatcatggaagtcttgcccagtcggttagcacgaaccattggccgtatttatgttgaagtggttcgaaacattccgctactggtagtgaccatgttcttttacattgtgattccgcggtatgtccccgcggtaaatggttttaccgccggaaccattggattgaccatctacacttcggctttcattgccgaaacggtgcgggcgggaatccaatcggtaagcgggggccaaatggaagcggcccggtcaaacggaatgacgtttagccaagcgatgcgttacattgtattgccccaggcctttaagattgtgattccacctttaggaaaccaatttattaacctagttaagaattcgtcagtgttagctttcgtggctggatttgacctgatgtacgtgggtaacgacattgcctccaccacctttgacacgattaactcttatctagtagtgggagtattgtatctcattattacgatgccgctaagttactacatgcggtacctagaaaaacggacgaatcgaggtgtcgcctagtgcacgcatttatggaagcctattccgcggtaaatttagcgttcttgttaaagggactgtggataactattgaagtttcggtgatttcgattatttttagctacgtgctcggtggaatactgggattgatccgttaccttaacgtacgctacttgtcagcgttggtgggagtggtgattgacgtaatccgaaacttgcccctcttgttaatgttcttcttcgtttactttggattgcctaacttgggaatccggctgggaatcttgccatcttcaattttggcgctaacggtatttgaatcagccatgattgcggaaattattcggggcgggattgtttcgatcgataaaggccaaatggaaggcgcccgggcgaacgggttatcgtattggcaagcaatgcgctacattattttgccccaggcacaggtccggatgattccagctttggttagccaattcatttcgttgattaaggatacttctttagcgacgattatcatgcttccggaaatgatgtaccacgcgcaaatcatttacgggcaaaacacaaattatattattccaatgtttgtggctttagcaggaatgtacttcgtggtctgctataccttgtcgatcatctcgcgaaaactagagaaaaaattagcgtaagattgtaaaattaataaaaaatggcattcaaccccattcgttaccgaatcagagttgaatgccatttttgcgttagtagctaacgaaattttaaattcgatcttcaggttggacaacgtactgggcgagacgctgataatcactgtcctttagttcggcggtgattttagttccttgatcggtgtaggaagttttctttacgtcggcattgccgtttaagaagttgactacttgaccttcatcaaaaggaatcaggaaatcagcacgtacgtagtttttaaatacttgctttttaattaacgaagttagcatttcgagtgattgaagctgctttgccgagtaggtgagttcggtaccatccaacgtcgggtaagcgatgcctgcccggtcggccttgttaaaggcgtagatcatgggaacatcggtgaccccaatttcttggagggtgtccgcagtagtttgcatcatttcccggtaatgcgggtcggatacgtccacaacttgtacaaggaggtccgctttagcagcttccgatagggtggaacgaaaggcttttaccaactggtgtggcaaattgctgacaaacccaaccgtatcgctaagaatcagttctttttggtctgggaaggttagtttgcgcacactagtgtccaaggtggcaaacagcatgtctttttcgaaaacttgcttgtcttcattgcgaccgtacatactgattaaaccattcatcgtggtcgactttccagtattggtgtacccaaccaaggctacgctaggaatgtcctttttatcccgacgctggcgttgcacgttggccgaagtggacatttccttaagttcctggttgatgtggttgattcgattgcggatcgtccgccggtttaattctagcttagtttcaccagcaccccggttagtaaatccaccgccggtatttccggcagtttgttggtcaagtcgctgggtagcgctagtccgcaagcggggaagctgatattgcaacttggcaagttcaacttggagacgggcctcttttgaacgagcccggttagcaaagatttctaaaatcaaaccggtgcggtcgatgactcgtaactgggtttccttttctaagttgctaagctgactaggggttaattcgtcattaaccaccagggtttcgacttcgcgagccgcagctacttgggtcagttcttcaatttttccttttccaaaataggttgcggcattaggccgttctaatttttgggtaagctggtccatcaccctcatgtggttagcagatgctaacgacttaagttctgccatggcgtaatccaggttaacgccaggaagttctagaccggcaataataattggttcttcattgatttcttcgttcatataagaatggcctccaaattattgaaaacgtttatataattatatcatggattaggcgggggtagaaaaataagcattttatggggtgagccgcgtaaatttctctgccgtaataagaaaatgagagtgggacaaaagttgggtatgcaacctattcgaaacgtgtttccagccccaaccctttccggttaactaaaaaaagacctaattgtcaaaacaattaggtctactttttagttgagcgtgtggttctatatgttgcagtcgaaacgtgttccagtcctcagagtcttccggttaatcaaaaaataggcataattgtttggacaattatgcctattcctcgattaatcctcaaactctccccgaggacttccacactctgccaaaatattccaccattccatcttggtccctcaattttaatttggtaacactcccgttgcgggggctatgggacacgtcaatttccgggttgaacatggacgtcaaaattcgaatcaaagtcccgtgcgataccaccaacacgttatcaccatcgttagcttggtcaaaggtgtaatccaaaccttgttgcaaacgggtggtgatttccgtgtagctttcggcatcgtggaacggatccacgtttttccacacgtcgatggctgccttaatgccatgtaaagcggtcatggcgttaagggttggttcaattgtggaatgttgttgataaagtttaaattcagtttctactgaattagcaccttcgaaataaccaaaaaattgttcccgaaaagctgcgattggttcaatgcttttttcgggtagcgggtggtgatttcgttggttaatgaaccgggccgttttaattgcccgggtagtatccgaacagtaagcgcgggcaaaatccacattcgctaagaaatcacctgcttgttgggcgtcgtgcacccctttttcggtaagtggtgaatcggaccagccttgtaaatgacggtaccggttgaataaggtttgcccgtgccgtacaaagtaatagttaacagttttcatgaatctatgctttcttaaatgattttctaaaaatgttaaagaagaggaagtaaaccgctaaggtagcgaccacgataattccccaagcaatcacgccagaccaaacgtcagcactgtagtggcccttaattactagataagcgcccacaatgaaggttaagattgcaaatgggtaggaagcccgggaagtcttcttcaaatggttacgttctacccacgccatgtaaggaagcaacgcggatagggcaatgaaaattaccggaatgatgatgttcaacgctaattccttgtcgtataaagcagttcctggcgtcgcgtcggttggacgaacccctaacagtgaaaatacgatggtgattacaaagcaccatgctcccaccaaccaagcaagaacgtcgtttttaatgaagacgtaatcactgtggaattctttactcttttgccgaatgcgcatgaaggcaaagaagacaaaactagttacgaatggcgaaacaattccgttgatgttcaaaagccagttgaacatatcgttaatacttggtagccagttactgaggaagagtaccagcgaaacgattccagtggttaaccagtacccattgattggcaaaccgtcgctatttagtttacctattgacttaggcaagtacttcattgcgacgtcagacaagaagatccgggtgctggcgtctaaaataaccgccaattgggcaaacatgtaaagggcttgactcaccgcaaagatgtacatgagggtatccccaattccaaattcctttcctagcgcttggaaggcgtagtaggaaccgttcatctttaaatcgtaaggaaggtggtgagcgttaaagaacactgccaacgagaacgaaccaaagacggtgaggaaaatcgtcattaataggagcatcatcatggctttcgggaagtctcgtttaccatctttcatttccttaacgtatggtgcggcaagttcggcaccgttaatcgcgaaaattaataacccaaaggtagataggaagtgtccatcaattttagggatgaaggcccgcacgttaaagggctgggtagcaatgtgacgaccatgcattagggcggcaaccgtcattaccacgaaaagaatcgtcattacaaacatggccccgccgcctaaagtactgagaatctccaacgagcggttgcggaaaaagtgctggaaccaaatgaaaactaaaaagaccaccgcggtgaagagggcaaaggcaatcgtgggcatgtaggattgtaaatccccgttccccttaactaaccaactaattgaaactaccacggagttagcaacgtcgactacgtatggtaatcccgcaatccagtagaagaaggccacgatgtatccggcaaggtccccgttagttgcgcgaacccaggaagctaatccgccaccgtcttcgttgaaagttccgcctagttggccaaccatcatttcgtacggccaaacaaaaagcaggatcatcaaaacccaggtagaaacaattgctaaaccttggttatgaaaattgtaaattaaatcgtcaaagccaattacggtaacaaagtccatcagagcaacgaccggccagctaatgtaccttttttttgcatctaaaggtgaattttccattcttacgtctctcctatgtaaattttaaatctcaattctactattcttaattgttatattcgattaaatgaattccatcttcatcaagggtaaaacgggtaatgctgccatttttaggtccccaagtgatgtctagttcaggatctgctttagctgcgatggaacggattgtcgttccgtggctgacgatgaggatttgatcgccatcgttagcggtcgctagcaaatcattaaatccacggttgattctttcccaaaattcggcgttgttttccgcatcgtggaaaggatcggccgctttaatagcatctttagtttctgcaatcgggcgttcttcgagaaattcgtggaacgagcgttttccagaaatcggcatcaaaacttcaaaccaagtttgggcggaatcgttgccttcgaaatagccgtaaaattcttcccgaaattcggttttcggttggatttcagcggtagtatgcttgttttcagctaaaatggcgcgggcggtgttcattgcccgggtggtatccgaagcgtacaccgcgtcaaacttagtatcgcttagtcggacgccagcttggtgggcgtctgcgtaccctttttcagttaagggcgagtcggaccagccttgcatccgattgtacttattaaaaatggtttgtccgtgacgaacaaagtacagctttagttgtttcatcagcttctgtccttccttattttttgtaaaacctcaaccattctatcataaattaaatttccaaaatgacttaaatctttgtgaaaacgcataaaaaggagtaaaatttatgtctaacaaaaccgagaggtgaaacatattggcagacgaaatttttaaatatgaagaaaaacatttagcagaggtcttagataaggtagacattgctatggataaggcccaaaaagatgctaagaatgccgaaaatgatcgcggagcaatccaagataatttttataacgatgtccggatcaacacttccagttattcaggaatgatggacacggcaatttcgattcgccaacaacaacagttgctcgaagagcgcgagaatagttggcaacacgcaaccaaacgaattaaaacacttaaacaaatgcaaaaacggccttacttcgcccggattgacttccacgaagagggcgagaaaaatgacgagaccatctacatcggactgggctcgttttcggatactccggaccactttttgatttacgattggcgtgcgccaatttcaagtgtttactatgatggcaaaatgggccacgtggagtacgcaaccccagatgggcaacaatccgtagatttaaagttaaagcgccagtttacgattgaagacggtaagttgatttcggtttacgatactgacgaaacgattggcgatcaaatgttattgaacgctttaggctcacagtcggacgtaaagatgaagagcatcgtttccaccattcaacgcgaacaaaatcaaattatccggaacacgtccgcggaccttttatttgtgcaaggggcggctggttcaggaaaaacggcggcaattttacaacgagttgcgttcttgttataccgttatcggggaaaactgactgcaggccaagtgattatgttctcgccaaaccagttgtttaacgactatgtggaccaagtgttacctgaattaggggaacaaaacatggtgcagatgacctattaccaatttgcccggcggcggattcctaacttagatgtggaaaacttacaacaacggtttgataagcagcttactgacgcagaacgaaaaatcgaccaatttaaaggtagtttacaattctttaaagccctaacccgttatgcacagcaccttgggaagggcggcatgcggtttagaaatatcatgttcaaggaaaaaccatttgctagcagggaaaaaattaaggaaatttactattcgtttaacgacacttatagcttaagtaaccggatcgacggaactcgagagaccttaattcgcatgcttaaccaaaaggttgggagcgaactacggacgaaatgggtagaagaagcggtgcaaaacttaagccaagaagaaattcacgagttgtttaagaataaacctcgcgaattcaaggacaatgacgaagaatttaagtttttagctcggcaaattgtggttaaagagttaaaaccggttcggaacgcaattatgcggaaccgcttcttgagtattaacgcgcagtacgtccacatgctccggactttgccaaagtggtataagttagaaaaaatcggggttaccgaagcacagtggcaggcccatgtggaaaaactagtggaaaatcttaaaaatcggcaattaacgatggtggatacgtcagcgtacttgtacctctatgatttaattactggtaaacggggcgaccgttcgatgcgctacgtgtttatcgatgaaatccaagattacaatgcctttcaactggcttatctgcggtataacttcccgaaggctaagttcactttgctaggggatttgaaccaatcaatttacgcaaacgaaaccagtaaaacccttttggcagaactttcgaccatgtttgatccagaaaaaactaaggtagttcagttggcgaagtcgtaccgttcgacgcaaccaattacggacttcacgaaggagattttggaagagggcgaagcaatcgaagcgttcaaccgccaaggcgagttaccccgggttgccgttactcaagatcaagctaccatgcttaagacggtccaagcccagttagaacgggaccgccaagaccacgaaactaccgcaattattggtcgtagtttagcagaatgtgagcaaatcacggagcagttacaggccgctggagaaaaggtaactttaattcgcacggaaaatcaacgacttgtggaaggaactttagtagtcccatccttcctagctaagggactggaatttgattcagtgattgtttgggatgccaacgcggaaaattatcaaagtcaccgcgacgaacagttgttatacaccatttgttcacgggcaatgcatcgtttattagtagtagccaagggacaacttagtccgttaattgctaaaatccccgagtcgttataccaaacaattaattaagttatgcacagcaaacgatggataatggggatcaagttgcaaagagtgcaaaaagcaatatttacccgatccatggtaataaaattctgatatagtagttatgtaaacactttcaagaccccctaaggaggaaaaagatgattcaaagcagttacacgagagcggattcgattctggacagtctcattaaccatgatgtggaatatatttttgggattccaggtgccaaaattgacttgttattcgaacagttagagcattctaatcgggctcgtaagccccggttaattattacccggcacgaacaaaatgcggcctttatggcggcagcggttggccggattaccggaaaaccgggggtggttttaaccacctccggccccggagtgggtaatttagctaccggattagttaccgcgacggcggaaggggatccggtattagctatcggtggacaagttccccgtaacgaccttttgagactaacgcaccaaagcatgcgcaacgcggatttgtttgaaccaattaccaagtacagtgtggaagtgcaggaaccagaaaatatttcagaagttttggcaaatgcctaccgggctgcggaatcttctaaacaaggggcaagttttgtgagttttccacaagacgtggtgaacgcaccggttagcacccggccaattcaacccttgaagaagcccattttaggaccagcaagtcctgatgaaattaagaaactggcggaagccattaaaaacgcccaacttcccgtactattgctagggatgcgggcgtcatcgccagaagttacccaagcggtacggcagttagttaaggaatctgatttgccagttgtggaaactttccaaggcgcgggaatcatttcccatgatttagaagaccatttctacgggcgggtcggacttttccgcaaccaacctggggataagttgttgaaacacagtgatttggttattacggtcggatacgatgccatcgaatacgaaccgcggaactggaatgcggaaggggatggcaagattctcgtaattgatgattcaccatccgaaatcgaccacaactttgaacctgaaaaagaactagtgggcgacattgcccaaaccattaatctcttaacaccgcacctcgcgggttaccaaattagtaacgacggagagcagtacttagagcagttacgcgaacaacaaaatcaacaggacttaccgcccgaagcggaatcggatacccaacgaatccatccgttatcactaatttcagcgctacagtaccgggtcgacgatgaaatgaccgtttcagttgacgtgggaagcttttatatttggatggcgcggcactttagaagctatcaaccacggcacctcttatttagtaacggaatgcaaacccttggagttgccttgccatgggcaatttcagcggcattgttacgtccgggtcacaaatcagtttccgtttctggggacgggggcttcctgttctccgcgcaagaattggaaacggccgttcgggaaaatctagatattgtgcacattatctggaacgatgggcactatgacatggttaagttccaagaagaattgaaatatggcaaagctgcgggagtaaactttggtccggttgactttgttaaactggctgaaagttatggtgccaagggcttgcgagttgatggaccagcagatctaggaaagaaactggacgaagcgtttcaaacgaagggaccggtagtggtcgacattccggttgattatcgcgataacgttaagttgggtcaatccttgctaccagatcaactataaaatatttgtaaaaaagggggattgcagatggcaaaattatttcaacacggcacgttagcaatgttagtagacggacttttcggcggaactttgactgccgaagcattattagaacacggcgattttgggattgggactgcggaaggtcttgatggcgaagtcattattttagatggggttgcttaccaagccctagctgacgggagtgttcgcattttggaacccgaagccatgttaccctttgccgacgttaaccaagcggattttgagggacacgtggttttaccagaaatcgaaatggccgaagtagatgcgacattagctaaagaattgtcataccaaaatacatttgtggcaattaaaattagcggactcttctcccgagtgcaaacccgggtggttaaaggccaacagcgcccttacccaacgttgagcgagaccgctgcaaagcaacagatctttgatgcacaaaacattaagggaaccgttgtgggatactatagtccgaaactattccacggagcgagcgtggccggaatgcatttgcatttcatcgacgatcagcaccaattcggcggtcatttattagattttaaggccgatcaagtgaaactttcctggcagattctggacgggattgacttgagtttaccgattaaggactccgaatttatgaagcatcaagctagtgacgtgcgagatattcaacagtccatcgctgaatcggaatagttaaggaattaatcgaagacgaggatttagtaatcatgcaggcacaaggatatttcacgtttgaccgcaccgcgtggcaaaatttatcaaatcgagcagaattaccgctgactcagcaacaattagccgacattaaggcgcttaacgaccggatttccttagaggacgtccaggacgtttacgttccgctggtacggttattgcagaagaagtacgctgattttgaaaaatggaaccgcgataaactggactttttacagattccggttaaaaaaacgccgtttattgtaggaatttcgggaagcgtagcggtaggtaaaagcaccactgcgcgcctattgcaagtgctgttaagcaactggtttagcgatttaaagacccagttgattactacggatggctttttataccctaatgctgaattaaagcggcgccatttaatgagtcggaaaggatttcctgaaagttacaacatgaaggaactaatccactttttaaacgcggtgaaaacggggcaaaaacagattaaggtgccgaaatattcacaccaagtttatgacgtcatcaaggatgaatacgacgtaattgatcagccagatattttaattgtggaaggcattaacgtactccaattaccggctaacgaaacgatttacgttagcgactttttcgattggtcgatttacgtggatgcggaagcggacttgattgaaaaatggttcttggaacggttcggcgtgttattggatacggcattccacgatccgagcaattattactaccagtacgctcagatgccacgggaagaagcctttgcctacgctaaaaaaatttggcgcgatatcgatttgaaaaacttaaaagaatatattttgccaacccgttttagagccgatatgattctacacaaaacggaggggcacgtgatggacaacatcttagtgcgcgtgtaggcgccgttctacgtaagaaacgaaggaaaaattcgttttaaaaaattaggaggctaacttgttgcgattggctttaatagagcccaaacgtgcgctaaaaagttagttttacttaaccccaatcgatcagtgtgcctgaatttggcatactggtcgatttttagttaaggcacataaattgagttgtctaaaagtacggaagaacaagaggatggcttggactaggaaaggctgattagcctagttgctaatgccttaatgcgaccaatggataaggcttatgttagcgaatgagaaagctaattaagtacggatagtaaataaggcagtactaaatgcttttctttttggaatgatggtgatacacttactaaaaataccacgaggagttaactattatgaagatgtgttgttgtttgatatcagtctaatgaataagtgatcaaattatggattcccttatttgttagcgaaccagcttatttggatcttaagggcaattcatattgatcatcaacacaccttctatacaatttttttgacgtgcaaaaggggttggggtataatctgaatagatcccaactctttttagttaggaagaaaaattatggtgaatgaaagattagttaaactactaggtaaacatcgcggtggtcaatcttgttaatgatggttagtgataaaaatgcatgtaataccataattaataagagggaatgaagatttatgaatgatttgatgatttgggtaaccgtggggattgctggcgtgatcctgcttgttttagctttattacaacgaaagaacgtgagcttcaataagttagttttgattggcttggttttaggattaagttttggagcaatcactcaagcaatttttggatcaacaagtaaagttgttgctaccgcagttgattggattggaattgtggggaatggctacatttcgttattacaaatgctggtaattccgctaatcgtaatatcgttaatcagcgcgttcaccaagctaggagacactaagaatctggggaagattgcgagaaacgtgctaacggtgttattaataactacggcaattgcggcatttattggggtaattaccgtgatcgcttttaacttgcaaggagcgtcgtttgtaaaggggaccgcctctaaagacaatctggcctttttacaacaacaccaacacgcattatcagaattaacggttccgcaaaaaattgtaagtttcttaccacaaaacatttttgaagaccttgccggaacgcgggcaaccagcacgattgcggtagtgattttttcactgattgttgggttagcgtatatatggttaaaagaacactatcctaacgacgcacttgccttcgaacggggcaccgatattctagataaattaatatccagaatggttcgcctcgtcatcaatttaactccgtacggaatcttttctttgatggcaaagacaattgcggtgaatagcattaaaactatcgtaagtttggcgtactttattgtagcggtctacgtggcattgttgttggtgttggtagtccataccgtaattttattattaacgcataccaacccgattgagtactacaaaaaagtgtggccaaccctgatttttgcgtttacttcgcgtaacagcgcgggaacgttgccaatgaacgtcgaagtacaaactaagcaactggggattaataaggccatcgcagatttttctgctagtttaggactcagtattggacaaaacggatgtgcaggaatttacccagccatgattgcgtcgatcacggctccggtagtgggaatcaacatcgtatcggttaaatttattttaacgttgattattatcgtcaccatttcatcctttggggtggctggctcaggtggcggcgcgacctttgccgccctaattgtcttagggacgttgaatttaccagttggcatcatgggaattgttttggcaattgatccgattatcgatatgggtcggacgttagtgaacgttaacgatagtatcctagccggattggtaactgccaaacgaagtgacatgttcaatgaagatgtttttaacgggaaagaaaaaattgaacaagcttaattgagtgagatgaattagtttttagtgttttaaattaaaggaccgtttcaggaatttttagattctgaactggtccttttttattttaattaaaaacgtcatcttttaagcgctagtttgatgaattggtgattggataactaaaaataacttattcaattagcgttaagccggcggcatcgagaatttgtaactggtgtccaggaagctttttaatcaaatggtggctttcccaacgttttaggtaacggctaatggtttccggcgtggttcctaacaaggtggctaggtccttatttttgagcggcagggtgaaaggattggcttgcaaactagcagaagtttcgacgaggtaatcggcaagtcgttcagcaaccgattctgtattagtcttggtggcttgagcttcgagtgacaatagccggttgcccagggtgttcatcacgttcacggcaatttgaggattgcgggttagaagctgttgaaaatccgcccgcgcaatcgtgcacacggtggtcggggttaaagttgtcgccgtggaatggtgctcaagttggttgaaaagggctgcttccccgttgatgtcaccgctttggagcaggtaaagcagatgttccttaccgttttctgcgggtcgaaccaccttaacttgccccttggcaacgatggtcaaggcgtcaacggcgtccccggcttgataaagaatttgttgggccgggacgtgacgatggcgaacgattgcttcaatttgctggctttgaacgggggttaagtttttaaaaatcggtactaagggcacgcaatggtgcgcatcaacgagggtggccattatatttctcctttgtttcattagcaaagtgcaaatttttttgtcaaaacttgaccaaggtcaatttcaaaaaggtcgggtacttctatgcttaatatatcaaagcaaggaggaaatataaaatgactaaggttattctgcaattagatacgttaacttgcccaagttgcatgacgaaaattcagggtgccctcactaaattggcgggggtccaaaacgttaaagtactttttaacgctagcaaagttaaggcgctcgttgatgatcggttagatagtacagatttaaaacggaccgttgaagaattaggatatcaggtaaaaagtgtgaaaaccaaggaggttattgagtaatggcaaaatcaattgaagaacgttatttagcagagcaaaagcaagctgaaatcgaccaccaccaaccaaccgcgggagcgatggcggatcatgttctggcaaatttacgcgtgttgaccaataaactggtgcaagctgcttggtacgttaaggggccaagctactttgccgaccgggaatatttgctacagttacaggcaacgttaaaccatgatttcgtgcaattaggcgaccagcttcgtgcggtaggggaaaagcccgcttccgtcaccgcagaatttagcgaatacagtatgcttactgaagatccgcggattaagtattactcgacggaagctatattggcggggttagtagcagattgccaaactagtttgatgtttattcagcgcgccattgcgttggctaaccaagaaagtaagtttcccttagcaagctacttaattgagcttaacggacaatttgaacgggcttcacaaaaattacaggcccgtttgggaaaagaaccgcgcgaaggtttggaagaagacgatgatgatgattaaaatgcaacgctggtttacaaggtttgctaacccgttgctcggggtggctgcgttattaaccgccacgggatggctgctgcaacatggcgggggttccccagaagtggctgggatggcgtatggcatagcaacgttgatagcggggatgccgatcttgttgaaagcaatcgctgcgttacgcgcccgggtggccagcattgaattgttagtaagcattgccgtgctaggagctttaatcattggggaactagaagaagcggcgatggtcacttttttgtttggcctaggtaattacttagagcgccgcactttaaagcagactcaccgggcgttagctaacctaacagaaatgcagccgacacaagcactcttagtgagcgaaggacaaacccgcacggtagcaattgacgacgttgaggtaggcgaccagttattagtgcggattggtgaccaagttccggttgacgggcgggtggttaccgggacggctaccgtcaacgaagcggccattactggtgaagcacgggtggttaataaaacgcccacggatcaagtatacacaggtacaattgtggaaaacggacaaatggtggtggaagcccaaaaagttggggaggaaaccacgtttggcaaaataattgagctcgtggaggaagcccaagacaatcaggcgccagtaagccgttttattgaccagtttgccctgttctacacgccactggttttagtgttagcgctcttaacacagttagttacgcaagacttccggttggcgattacaattttggtgctggcgtgtccgggagcgttagtaattgggacaccggtatccaacgtcgcggggattggccggggagcgcaaagcggcatcttgattaagggcggtcaggtcattgatcaactggccaaggtgcgtaccatcctcatggataaaaccgggacgattaccactggtaaaccgaccgtccagagcttctatcagtattcacaacaagattggctagcggtggcggcccaattagaaaaacaaactaaccaccctttggcagcggccgttgtggaattttatgaacaacgaacgggccagcctgtgcaaaaccatgagatcgcaatcaccaccattaaaggaatcggggttaccgccacttggcatggtcatcgggtgaaattgggaagcccgcggattttagaaccaagtgcccaaaaactttctaataaacagactgttgatttacaaaaactgcgggaaaatgggcaatcggtaattttaatgatcgtagacggtgctttagtgttggcaatgggcttatccgaccaagtccggcccggcgtagctagcgcacttaaacaacttcgccaaaccggagtgacgaatcagtggatggtgactggtgatcaactaaacgttgcccagtccgttgcgcatatcgtgggaatcacccaggttaaagcaggtcagttgcctaacgaaaaggcccagtttttgaaagaactccaagcaagcggtcaaccagtgctattcgttggcgacggaattaacgacagtcccgccattgcccaagcggcggtgggaatcgcgatggggagcggcactgacgtcgcgattgaaacttcggacgtggtactgattaatcccgattttaaaaatgtcgtttttgcgcgacaaattgctcaagcaacgctgcgtaacatgatggaaaacgtaggaattgcggttggtacggtggcgttgttgatgttaggagttagtttaggctgggtaaatatggcaagcgggatgtttttccacgaagttagtatcctggtggtgatttttaacgccatgcgattactgaaactaaaacggcccgcctgggagaatttttccaccaaaactggcggtgagagcccttccagtgaaactatctaagtgatagggctatggtttttcacaattttcctgtatgatagaggataagaatgaaaagatgaggtgaaggacttggcaaacacagatttatcaaattttgataaaatcattgttttggattttggtagtcaatacaaccaattgattacgcgcagaatccgtgaatttggggtttactcagagcttctttctcataaaatcactgcggaagaaattaagcagattaatcctaagggaattattttctccgggggaccgaacagtgtttatgatgacgatgcttttcgagttgatcctgaaatttatcaattaggaattccaattttgggaatttgttacggaatgcaattgatggcctacaatttgggcggtcgggttgaatctgcggataaccgggaatacggccacgcagacattaacgtaactgatgaccaagcggcattgtttaaaggcttgccagctacccaaacggtttggatgagccacggtgacttggttcgcgaagttccagccggctttaagacggtagctactagcgcaaattgcccaatcgcttccatggcggatgacgaatggaaattttacggcgttcaattccacgcggaagtgcggaatacgcaatatggtaacgatattttacggcactttgcctttgatgtttgtcaagctcaagcaaattggtcaatgaacgacttcattgacatgcaagtggaaaagattcgcgaagaagttggcgaccgtaaagtactcttaggactttctggcggggttgactcaagcgttgtcggcgtattgttgaacaaagcaattggcgatcaattagtatgtatctttgtggatcacggtttgttacgtaaaggtgaagcaaagcaagttatggatagcctagaaggcaaattcggcttgaacattatcaaggttgacgcacaagaccgcttcttgagcaaattagccggagttactgatcctgaacaaaaacggaagatcatcggtaacgaatttatcgaagtcttcaatgacgaagctcaaaaacttaagggaattgatttcttagctcaaggtaccctttacactgacgtaatcgaaagtggaacggatactgcgcaaacgatcaaatcccatcataacgtgggtggattgccagaagacatgcacttcgaactaatcgaaccgcttcggaccttgttcaaggatgaagcgcgtgacttaggtgaaaagctgggaatgccagaagatttagtttggcgtcaacctttccctggccctggtctaggaattcgggtgctaggtgaaatcaccgaagataaattgcaaattgttcgcgatagtgacttaattctacgtgaagaaatcaagaacgctggcttagatcgtgacatttggcaatacttcaccgtcttaccaggaattcgcagcgttggggtaatgggtgacggccggacttacgactacacagtcggaattcgtgcagttaactcgattgacggaatgaccgccgacttcgcgcggatcccatgggaagtactccaaaaaatttcggtacgaatcgtaaacgaagttgaccacgttaaccgcgtagtgtacgacattacgtccaagccgccggcaactgtggaatgggaataattggtaagggtaaagcaggtacacaaatgccgttataaaggcatttgggggtatataagtaaatcaaatttaattaaaataaatatggttccctgccaattccctgccaaacaagttggaataatactagtctaattaataaataaaatgcacgtcgagaaaatttttctcggcgtgcattttgtttttatttcgtaagaaattttaagtttaatgagtacgatagttggaacttacattaggtaatagagctagacgttaagggaaaattatttagttatttttaatttaaatttgtaccattgtatagtagcaccccatgatattctgattgcttataattagtatctgtaattttagctatggcgtcatttaggtcttttggtttttcgttgctttgcccgctatggtcagtctcataagagaaattcatatcagaaatatcacctttggtgaggtctgattctaattttccatcgtgagccttcagcttattaccttcaaatactccataattaagccccgtgttatctacatatgccactgaaattctaccatcaggttgcatagcaactaaattaggcttgtgcccactataatcaaattgattcaaaaagctttgccagtctaactcagcagggtcttttaaatcatttatcttaacggacaaagcttgtccgccaacatctttttctttgccatcattaattttgacgcctttattatcaaaataatcattaacgttactactaaaactatcactatgcatgctatcagaatccaatgattccaacgtaacttccccgttttgtgggatttcatcttcatttaattcagccaatgtaccattaatgttcttatatggcgaatcaactacaatttttccccatgttttgtcagtgttaaagccagaatataactctttagtattcttattcggtacaaacttaatgtatttattcatttccttaattgtaaaggtcttcttttcagcaacttttttatttgaagtactcttacttgtttggtttccattaccattattagaattaccacatccggctaatccgattgccaaaccaacggttaaggctcccccaacaagtacacttatcaatttggttttcttcattttcagactccttctttatttgttttggacccaccactcgcctgtttctccagttgagctttttcctggataagcgacatgaccattaattttggtcttagcgctaagatcaatatagctgtcatcttccgactctgattcagattcttcctcctctgagtcaaagtgaatatacaatttgtgtcccttaattttccagtctccactagctaagaagccactagtagttccatcgtcatgaaaacgtacgtagccttcactatcatttttagcgtcatcataactttcaggtttttcactttcagttacaacataataagaatgcccattaaagtcccgagcaggattattcaatgttttaaatgcaaaaaatacacatagtactatagcaatcactccaacaagcttgatagtcttgccattttttccgttcaaagtttctttaagtttatccattgatcatttctccgttccttttatgtatttttacgtgggatatcttaagttgagatgtgcaggattaccaacccgcaggtacgttatagctgccgtctccgtcagtatcagaagcaaaagtaccatccgattttaacccaatgttttttccatcggcattgtccaaagaccaatatgtattattaccttcaacgttttttacatggacggtccagccttgattaccttgttttttagttgcgtaagcaattgcttcggcgtcggtagtcagatgaaccttgccgtgggtactatcaaaactttggggacttttttggccttggtgaattttaacaatgatgtcatcgacctgcttaacctgcgcgggtgtagagtagtagcgttgttctaattcagctaaactaatggttttaaatgggggatagtgtttattagccttgcgagaatattttacgttgttaccttcaatttgatatgaaacaatgcaaacgggcccaccatttccaacaaagtttccgccatcattttgccaaattccaaaattgatttcttgcatgatgtcatcatcggggtaacacatttggaaaagcattaccgcaattttctctttatcccgagttttgacggcaatgttctgggtaaaatgcttttgtgtctttttagtagttgtggaactacttgaccgcgattgtttagcgactttgttagttttactagttactgaagatgattgcgttgttttagcttggctaccgcaggatcccaacattaatgaaatggtaagtaatgcgactaaggcgtaacttttcttcatttaaactcctccaaaaagtaaatagttaatacgagtggattctaaaatacgtaggaatgaatgtttttcaaaaatcagctcctttcaaaaggatatccatcagctttataatgttagtatatcaaatgatatatgcatataaaaatagttgaataaaaatggtttaacaataaaccgaaaccattctttgaaacagtttaatgtcgtgttctttgaatatcattttgcctaaattttctgttgggacgcaaaaataacctttaatatattttttaaaaaagtgtaattatatagttgattaaaacacgaggcaattaaaaatgaactaatatgatatcgtcagtattgattaactaactttttatgattactacgatgaaaataagttaccaaagtgtagttgcttgaatgcttacaaaaagttagctatcatagagatatagattaagaccaattaataggaggaacggagaatggcaaagatatttattgcgggcggctctggacgggttgctaccgccttaattaagaatttagttgcggatagtaatgaagtggttgctggagcgcggcatcctgaaaacgttgttgagatggaccacgtgaacgcggtaaagctcgatttgcatgacggggtagacgcgatcgccgacttaatgaaggggagcgacgccgtttacttcactgctggttcgcgaggcgccgacttgttgcaaactgatgcgatgggcgcggttaaaactatgcaggcggccgaaaaactaggcattaagcgttacgtcatgctaagttcgctatacactttggaatcggaacgtaagtggcatgagggcggtttggcagacctcttggattacacaactgccaagttctttgcggacaactacctcgttcatgacaccgatttggattacaccattgttcaaccaactagtttgactgaagaagcgggaaccggccaaatttacatcggaaaagagctcccacaaaagactaacccaattccagacgtggcaaaagttctagcagacgttttgaaacatccgaatactgttaaaaaagtatttatgatgagcagcggtagtcaagcaatcgaccaagcgttggctaacgtataaattttaaccaactagaatttcccccagtacgccaagaattcattaacgtgattcttggcgttttataatttatgagtaaaatattttgtttgtgaaaacgaactggatttttcattacggatttgacattttcctgaattattttcattatggtagaagcacgtttgatgaaaatgagagaggaagaaaaatatggaagcacaaaatacgcggcacaccaacccgatgattgtggtggcggtagtggcgttgatgtcctttatgggaattttgacggaaacctcaatgaacgtaactttcccagctttaatgaaggagtttcacgtccccctcaacacggttcagtgggtgaccgccggatacttattgatggccgccttagtaatgttaacgtcggcttacatgaaacgtcggtttaccaaccggcagttgtttaccgccgcggcaatcttatttagcagcggtgacttgatttgtggactagcgactaacttttgggttttgttagccgggcggttaattcaggcaggatgtgtgggactatgcacgcccctgatggtcaacattattctagacgtagtgccccagcataaattggggacttacattggaatggcaaacttgattattttaattgcaccggcacttgggcccacgtttggcggggcggtagttgcttttaatagttggcgaatgattttttggtcaactttacccgttgcgttagtgctgatgctgcttggcatgaaagtcatcaagcagtacgcgcctactgaccagcactacgcgtttgactggacccggtttcttttgttggggatggcgttagttagtttaattgttggattgaacgccctcggagaaatgcaattgggtacttttgtagggttgctgatcgtcagcattggcttaactatactatttgttaaacgctcgcacaccgcaacgaaagctttattttcactgcaagtttttaagcaaccagcctttttatacagttttctaccatatataatgctgcaatttgcaaacgtagggattaacttcctgttacctaattacgtgcaggatgtttttcaagcgacttcgttagttggtgggctaatcttactgccggggagtttgtttaacgggtttggacaaccattgtacggctggctgttggatcggtttggcggaaaagtgcccttgtataccggagatattttgtttacgttggcgttggttggcttaatgtgctggggacctcaattaggagtggttggaatcacgattgcttacttaattttcgcgattggccgctcgatggcgtttggaaattcggtcgcgtacggtctaaaacatattgacaaagaatttcaaaacgatgctaacgcgttgtataatacgggacaacaggttaccggagcaatcggaacgactgtcttagcgctattgatgggatcggttaaacgcccaggctacacccacgcgcaaaacgtaagtgcggggagtcagttagcatttattttgctagtaattttcggttgcgtaatctttgtgtttttccaccatttggttaatttaaagaatttgccagaagataagggcgttgatttataagcgctgggcaaaataggaggagcagcatggcgaatattgaacgattttacactaaatttcacccaactaattaccaaattaaattagcaattagtcgggaaacaaaggaaattaagggaacgaccaccattaccggggaggcgttaagttcccaaattgacatccaccaaaaggatctacaaattgaagaactacgggtagatggtacggcaggcgattttaccgttgatcaagccgcggaagcaattcacgttaaattaccgcacaccggaacggtaactttggaaatcaaatacaccaccaagttaaccgacacgatgatgggaatttatccttcatattacgaagtgaatggggaaaccaagcagttagtgggcacccagtttgaaaccacctttgcgcggcaagcctttccgtgcgtggacgagccagaagccaaggccacctttgatttagccattaagttcgatgaacatcctggcgaagtggtattgagcaacatgccagaaactaaggttgaggatggttaccactattttgcacgtacggtaaaaatgtctacgtacttaatcgcgtttgcctttggtgatttgcaaagtaagcaaactaaaactaagagcggcgtccaagtgggcgtttttgccaccaaggctcatcagccacaagagttagattttgctttggatattgccaaacgagcgattgaattttacgaagacttctaccaaactccgtatccactaccgcattcatggcaactagccttgccagacttttcagccggggcaatggaaaactggggtttggtaacttaccgggaagcttacctcttgctcgatccaaagaacaccactctacgcactaaacaagtggtggccacggtaattgctcacgaattagcgcaccagtggtttggtgacttagtaaccatgcagtggtgggacgacctttggttaaacgaaagttttgccaacatgatggaatacgtggccgttgacgctttggaacccgagtggcaaatttgggaattgttccaaaattctgaagcaggcgcagctttacaacgggatgccacggacggagtgcaatccgtgcacgtccaagttaacgatccggccgaaattgacgccctctttgacggagccatcgtttatgcaaagggagcccggatgctagtaatggtccgcgctttgattggcgacgacgctctccgtcaaggactgcaaaagtactttgcaagccaccagtacggaaatgctaccggaaacgatttgtggcaagcactcggagaagccgcgaacatgccaattggcgacatcatgcatacgtggctagatcaaccgggatacccagtggcgaccgcccaagttgaaaatggtgacctagtgcttgaacaacaacaattcttcattggtgaagggcaagctcaacaacgccaatggcagattccgttgaatggaaactatgcagaggttccggccttactacagacgaagaccttgaatttaggaaattaccaagacttacgggatcgaaaccaacaaccattccggttgaacgtgggcaacagttcgcatttcatcgtgcgctacgaccaacggttattagacgatattttagctgattgggagcaactgtccgcgatcgaccagcttcaactgttgcaagacctgcgtttgttggcggaaggtaagcaaatttcctacgcgaagattgtgcccttattaccacgatttgcgaaaaccgattctgcgctcgtaacggagatgttataccgggtggcaaatgatttaaagaagttcgttgctccgcaaagctcagcagaaaagcaacttaagaagttctttggtgaattaagtcaagcaccggcccaacggttaggctggcaagcggcggctggtgaaaccaacgacgaccagttaatgcgtccgatggtattgaaggcggctttgtacgctgaaaatccagcagttaccgcacaagcccatcagctatttgaagaaaacgaagcacagctgtcaaaactaccggccgcaattcgttccttagtaattcggaatgaagtcgaacattttggtagccctgagctttttgcccggttgcttaaagaatatcaacggacaagcgatgcgagctacaagagtgacctttgccaggcgcttacggccacaccatccttaccattgattcaacaactagttcaacagtttgaaaatgcgcaagtaattaagccgcaagacttgcgagcgtggttccgtggcgtattggctaaccctcaagggcaaggcccggcatggaactggattcgtgacgaatggcaatggctagaagacacggtgggcggtgacatggaatttgccacctacattacggtgattgcgggaattttccaaacaccgacgcgcctagccgaattcaaagcattatttgaaccaaaactagcaactccaggattaactcgggaaattacgatggatattaaggtgattgaaacccgagtcgcactaattgaaacagaaagggatgctgtacaagctgcggtagcccaagcaattaagtaacgtgataaataaagcgagagactgcgaaaaaactgaaagctccttttgcgggttggttctattagagtcaacacacaccaaaagctagtttgtcccgcttaacctaaaagcgaccattattatgctaaatttagacatagtaatggtcgctttttagttagtgtttgcaaactacccgacttttggccaatgcgctcgtttttaatttgcctaaagtgcggtgttagttatttgttaacgatttggtggttggaaaggtccccgtccgcgctttgcacgtcaccatttgcgtaaacgtagtaagaaccgtgcttaggggaggtaatgtggaaataaattggtgaagacttgccaatggaactaaaggccactttccaattttgattaccatatttttcggttagaagggcaactgctgcttgttcgttttgaattttctcgtcagcaaggggccggttgccattcttcttttctgccttcgttaagtcgctgcgggacatttgattatctgcagaactacttgagtcggtagccgaacttgttgaagaagaagcggaattagagctagagctagagctagagttagagttagtcgagtcttttgaagagtttgcgctagctgatgagctagttgctttatcatctgaacttgatttagcgtccttgctaacagacgacttacttgatgacttggccaccttttcggtcttgctagaattagaagatgtatcagagttagaagtagaatggttgccacaacttgccaaggttaatggtaagactgctaagatagcgattgacgcaatttttttcatggtaaaatcctcccccggattgatgaatttagtgctaataatttagttaattctagcatactcaagcaaaactgcaaggtacgcaaaagtttaatttaataacgttgaaaccgcttaaaatgcgttgagtaatcgggggaaaaacgatatagtgagattaataacgttgaggaggaattttatatgggtgacagaaagtataaccttggtctcgatatcgggacgtcatcaattggctttgcggcagttgacgaaaataaccaacccattcgagtcaaaggaaagacggcaattggggtacgtctctttgaagagggcaaaacggcggcggatcggcgtggttttcggactacgcggcggagattatcccggcgccggtggcggatcaatttattgaacggaatttttgatgcgcaccttgccgaggtggaccccacctttttggcccggttaaaagaatcgaaccggtcaaatttggatccaaagaagtcttttcaaggctcacttttattcccagaacggaaagattatcaattctacaaggaatatcccacgatttaccatttgcgaaaggcattgatggaaaaagaccggaagtttgatattcgggaaatttatttagcagtccatcacattattaaatatcggggaaacttcttaaacggaacgccgatgcggtcgtttaaagtagaaaatattgagcttgatacgttatttgaccggttaaaccagctttatgaagagattattcccgacaatgaactggcctttgatttagaacaagtggcggatgttaaggaagttcttagtagcacaaccatctataaaatggataagaaaaaacaactagtgaagatgatgctgcttcccgcaagcaacaaggcattacagagtgaaaacaagaaaatcgttacgcagtttgttaatgcgattttgaactataagtttaagcttgacgtgctcctccaagttgaaacggacgcggatgataaattagaagaattcacgggtgatttagatgaaaatcgtttggaaattattgatcttttgcaaagactacataactggttttcattaaatgaaattacaaaagatggtaattcgttgtccgcggcgatggttgaaaaatataaagaccaccgtcaccatttagaattattgaaaaaggtaattgaggatcattcagatgccaagaaagcaaaagcactgaaggaaacgtacacggcctacgtcggtaaaacggacgataagacccagaacaaagatgatttctataaggttgtggaaaagaacttagatgattcgccggaagcaaaagaaattaaacgtttaattcagctagaccagttcatgcctaagcaacggactgggcaaaatggggcaatccctcaccaactgcatcaacaggagctcgaccaaattattgaaaagtaatctaaatattatccgtttttggcggagccgaatccgaacgttaagcgccgtaaagatgctccttacaaactagacgaattgattgcctttaagatcccgtactacgtgggcccattggtaacgccggaagaacaagcacaaaataaagaaaacgtgtttgcgtggatgaagcggaaggctgccggtccaattacaccatggaattttgatgaaaaagttgaccggatggaatccgcaaaccgatttattcggcggatgactaccaaagatacgtatctttttggcgaagatgtcttacctgcggaaagcatgatttacgaaaaatttgtggtgcttaatgagctaaataatttgaagattaatgggcggcatttatcgcttaaggataagcaagacatttataatgacttgttcaagcaacaaaaaacggtttccattaaagcgctccaaaattactacgttaccaaaaagaaggctgcaaccgcgcctaccgtgggcggattagccgatccaaagaaatttttatcaagtctatcaacttatattgatttcaaaaatatgtttggggagcgggtaaatgatccgcaattccaagagaatttagaacaaatcgtggaatggtcgacaatttttgaggatcggggaatctttaaggcaaaattacaagccctgggttggctatctgaaaagcagattcaacaattggtggctaaacgttacaaaggatggggccggctttccaagaagctcttaactgggctaaagaacgcggaaggatactcaattttagacgaaatgtggcgttcgaccgaaaacttcatgcaaattcaaagtcgtccagaatttgcggcactaattcaacaggccaacgaaaaacaatttgagggcaacgacccgaataatgtttgggagaatattgaaaacattttgggggatgcgtacacttcaccacaaaataagaaggcaatccgtcaagtggtgaaggttgtccaagatattgaaaaagcagtgggtaacccacctgaaaaaattgcgattgagtttacccgtgaagccgcggcgaaccctcaacggacgcaaagccgtttgcggaccttggaaaagctttatgaaagtgccgaagaagttgtagacgcggggttaactgctgaactagctgaatttaaggaaaataagcacgttttatcggataagtactacctgtgctttacccaattaggccgggatgtttatactggggatcgaattagattggaccagctgaacgattacgatgttgaccacattttaccacagtcgtttattaaagacgatagtttggacaaccgggtattgacgattcgagcggttaacaacggaaaaagtgataatgtcccggttgaactgtttggtaagaaaatgagctcgttttggcgacgtttgctggataacggaatgatttccaaacgaaaatataataacttaattaccgatccggataatatcagtaaatacgcccaaaagggatttattaaccggcaactcgtggaaaccagtcaagttatcaaactgacggctaacattttaaacgggatttacgataaggacaccgaaattatcgaagttccagcgaaaatgaattctcaaatgcggaaaatgtttgatttggttaaggtgcgggaagttaacgactaccaccatgcctttgacgcttatttaaccatctttattggaaactatctgtataaatgttatccaaaattacggccatactttgtttatgataattttaaaaagtttggtaacaaggaagatataggacataaacgttttaactttttaggaaaaattgagcgagacaagaaagtggttgctcctgaaactggtgaaatcttgtggtcaaacgtggcaccgaatgagaccatcaagcagattaagaaggtttatgattataaatttatgcttacttctcatgaaacttacactaaacacggtgcgttgtttaatcaaacgatatactctgccaaagcttcaaaaacgatgattccaattaaaaatgaccgacctaccaaactttatggtgggtatagcgggaatgaagatgcatatatgagcattattaggttaagtgacaagaaaaaaacgtacaaagtagttggtatatcaatgcgcgatgctagtaagttgaaagcttatgaaaataatgcgcatgaagaatatctaaaaaaattaaaggaagttattgaacagcaatttttagatagtggcaaaaaaactaaagccgattttgaaattgttattccaaaagttaattatcatcaaagaatgcaggatggcacaaagcaatttagaattggcagttccaaatatgtacacaacactaagcagttagtattatctgagaaaactctaaaagccattcgaaacaataagcaatataacggagatgctgaaaaggatcttattaatgcttttgatgaaatactaactattgttaatgattcgttcagtatttttgatattagaagttttagaaaaaagcttaatgaaagtcgagataagtttgtttctttaccagtagaagatacaaaagaaaaaagcaaagttattaaaggcaagcgggagacgttgaagcagatattgattgcacttcatgcaaacggcacttcacaagacatcccacaactagggcttaaaagttttggaaaaatggttaaaactggggggcttacattatcagaaaatacagtcctaattcaccaatcgccatcaggattattcgaacgtaaaattaaattaagcgatctttaatgagagcatcaaaaaagaggagccgtcccattaagggtcggttcctctttcactatgtaatgcccagatagctgggacaaatggataaactccgcacaaagtacattgtttgatttcaaatcaggatgttaaatcaataaggttaaaagttgggagctacccaacaccattaatataaaccagtacactggtaaaatcaaggaggttttaaaaatatgggatggagatcagtaatcatcactcagcacgctaaattgtcgtattcggcacatgcgatgattgtgcagaccaatgacggaattaatcagattccggttgacgacgttagtttgttgttaatttcaacgacgcaagcggtaattacgacggcgttaatcagtgagctatcaaagaaaaacgtcaaaattgtatttaccgatgaagcgcgggaaccgattagcgaaatttacggctattatcccgctaaccggaccgcccagctgctgcgagagcaagttaactgggacttacagttacaacaaatattgtggacgaagttagtggctaataaaatcatcaatcagattaacgttttgaatttactagaacattcgaccgatgaactagtaacagaattggaaaaattggaattgaatgatttaactaatcgggaagcggtggtagcgcacaaatattttccgttattgtttgaaagcggttttacgaggagggacggttcggtaattaacgcggcgttaaactatggttactcaattttattgtcggccgtaaaccaagaaatcgtggcgaatggctacgttacatatttagggattcatcatgatagcgaggaaaatcagtttaacttggcttcagacttgatggaaccctttcggccagttgtggattgctgggtggcaaatcaaaaatttaatcaacttacgcctgacattaagtatgggctggtggaacttttgagtttggaacttaagtacaacggcaagaagatgattttacgtaatgcgattactgatcacgtacggaattgtttgaagtatttagcggggaaagctaatagttttacgattgaaatggagttaagcgatgaggtaccgaataatgcgattaatgataatgtttgatttaccagttgagacggcggtacaaagaaaacagtaccgacaatttagaaaagcgctaattaacgaaggctttttgatgattcaatattctgtttatgttcgcgtatgcgtgaataaaaaatcggcgacgtttatggaaaaccgcatcaaaacttatttacccgaaaatggcacaattcaggcccttacgttaactgagaagcagtataacgacatgcattttttggttggtgaacgggtaaaagacgtgcgcaatacctctgatcggacggtgatcctatgaaactaacgtatcgaactcatgaaccggtggaaattaaacctcacgcaattacggttttgggaaccaataattctacggtttataccgatttagtaaatggtatgcaggaacgtaacgaatttattttagcttttgatgaaaactacaaagaactcgaaattagtaaagttttcgattggattggcgacgtaggaacccaggacttagttattcaaaagtatttaactaagattgaacgggtttttgccgaagggttggtggatgagcaacgtaaccaaattcatgatcaggtaaaccaactatttaatacggttgctgaacaattatttatgctagatttaccgattagcgtcaattatgattttgatttgaaaaagttattgaagtattgtggagtgcactttgatccgctaagcgtgggtaacccatatggtataattgaagcgattttgaagattcacgaggagtgcgcgattaattcgtgtgtcgtgttaactaatgttgcacattatttgacagcgacccaaattgaagaacttacccagctagtaagtcaaacgaatcaagcactcttactaattgaattcacagaaataggcaatcaggaggcctatggaaatagcgaattctactacattgacaatgactttgttgattggcatcagtaattgatgaaattttagttagaaaataacggtttcagaaggatgttaaatcaataaggttaagatctcaaaagctcggttttgttttttatctcgagtttcagaaggatgttaaatcaataaggttaagatcaagtagcagtaacttgttgagttaatctccgtttcagaaggatgttaaatcaataaggttaagatctgaacccaatcgactttacctagccgaactgtttcagaaggatgttaaatcaataaggttaagatccttccacacgccccatcgcgcggccgttatgtttcagaaggatgttaaatcaataaggttaagatcccatgtttttgaatatgttcatacgaatcagtttcagaaggatgttaaatcaataaggttaagatcactcgactatagcggaagttgtcgttgtctgtttcagaaggatgttaaatcaataaggttaagatcacgtatacaggaaggtaggctgtgagaattgtttcagaaggatgttaaatcaataaggttaagatcaagtagcagtaacttgttgagttaatctccgtttcagaaggatgttaaatcaataaggttaagagcgtggctggttagtttgggtatctaagggagttttcagaaggggaataaagttaaatggaagtcataaaaaagagccaaacaagaatgaaaggttaacaatattactggcggtaatacaaaccataataagaactctagattggctcgggtacagttttaagaaataggattaagagacgtagatcttttttgccgctctctatatatattttataacggaggaataaaaaaatgaaaagagaaaaagcagttaacatagttattgtattgctgttaatttcaatcgtgttatctattttaaatctatttaagtaggtgtgtatcgtgagtttaataaagaagcacctagattcttataggattgctaaagataataatattacctagccaataatgacaaggggaattaataaggacttggataacttatcgtttaagcatcttaaagctatctccacttccctaggaaaagatatagtaacttgtcgcaaaagaattaaatatttttgtaaaacagagctgctcaaaaataatcgaacatttttttgttttgtctatttttgatgaaactactagtcatggaggatgataaactactaaggtccaaatgaatttataggtttagcatcattactcgaagacgatgttttagtggtggttggaaataaaatccgcccgaaacgatcgggtggttttcagtttgtaaaagtataccaattatattgatatagtaaatgcataaagttaagaaagtgataaaaattggatgatgaagaataaaaaaggtatcgcaataagcaaatgacaatagtgacactaatcattcagacgattacagctattgtacaactcatcacaatgcttaaaaaataggtaaaagaggcgatacgcctttcttctgttcatcaattttaaaatggaggcattaaaatgaaaaacataggaaagctacaatatttaactttgactatcagtatcgttgctctgatattgtcgctaataaatttactaaagtaggatggtgaaattgacgttttctaacgaagacctcgattctctgtcctttagattgataagatctctagcctgctcaatggaaaaacagttgaacatgttgtacagaaattagatgatttgcaaaataaaaccgctcgaaatcaatcgaacggttttattttgtctatttttagtcggtactacctcttttttattggaaccacagaggtattttgggaatgtcccacattttttatcactttttatacctttatgaaacggttataaaaagtcatttaaagaatctcattgtaatcaaaagagtttcaaaaggatgccaaatcaataaggctaatcaaaaatagatacgattatttattttaatattgcaatccttaaatttcctacatcaccagcggcaataccaccaggccgttcatcaaaatgtgtgcgatcattgaagtttggatgcgtcccgttttatggtacagccagcaaaatagcaggccaattgcggcgtataaaaagatgtggctgtcgttatgcataaaggcgaacgctaagctggaaatgatcgccatgatcgtcaaacctaagttcgagcgcatcccgaacagagtgcttaaattgccaaacaaaaccttccgaaaaactaactcttccataatgggagccccaacggtgattgccaacacgaaaaacgggttgattttcgctagggtaactaacgtagctgtgttcgcggaagcagggttttgccccagaataaaagtgacgtagctaaccacaaactggagcacgatcactaacgcggtcccaatgatcccccacgcaattgcccggaagaaggaaattcgtcgagtttcaatttggttgatttcactatttttcaggttaataaccaccagcagggcagctccgactaggtaatcgatagtttccacccagataaatgatgcacccgaccgaacgaaaaggttgataacgctcggtagcaagaaaattgctaaataagtgattaaagttaataaagaacttttactaattttcatcatgacactcctttatttcctgtaagtatagcatatttgaacggttgttatatttgattggttaatattggtcaaaaacacttgcattctattaaaaacatgatatagttatcagtgtagttagcacttaggtataacgagtgctaaataaatcatgcatttaattatcagaaatttggagggattcacgtgttaaaacctttaggagatcgcgttattttagaagctaaagacgaagaagaacaaactgtcggaggcatcgttctggcaagtaatgctaaagaaaagtcccaaaccggtaaagttgtcgctgtaggtaacggtcgcgttttagatgacggaaagacgttaccaatgaacgttaaagtaggcgacacagtagtttacgataaatatgcaggaacagaagtaacatacgaagatcaaaaatatttagttgtccatgaaaaggacttagttgcagttgttgaataattaatttaaaggagtgttgatcatggctaaagaaattaagttttcagaagatgcacgcacaaagatgctaaaaggggtcgacaaattagcagataccgttaagtcgactattggaccaaagggacgtaacgttgttttggaacaatcatacggttcaccaacaatcactaacgatggtgtaacaatcgctaagtcaattgaattagaagatcactttgaaaacatgggtgctaagttagtatccgaagttgcttctaagacaaacgacattgctggtgacggtactacaactgcgacagtacttacccaagcaattgttaacgaaggtatgaagaacgttactgctggtgctaacccagttgggattcgtcgtggtattgaaaaggctactgaaaaagcagttgccgcattgcacaacatgtcacacgaagtaaagacaaaggatgacatcgcacaaatcgcttcaatttcttctgctaacccagaagttggtaagttgattgcggatgcaatggaaaaggttggtaacgacggagttatcactattgaagaatctcgtggagttgacacaaccctcgacgttgttgaaggtatgcaattcgatcgtggttacatgtcacaatacatggttactgacaacgacaagatggaagctaacctcgacaacccatacatcttaattactgacaagaagattgctaacatccaagacatcttgccattacttcaatcagtggttgaacaaagccgttcacttttgatcattgctgatgacatcactggtgaagcattgccaaccttggtattgaacaagatgcgtggtactttcaacgtggttgctgttaaggcacctggttttggtgaccgtcgtaaggaacaacttgaagatattgccatcttaactggtggtacagttatcactgacgaccttggcttgaacttgaaggacgttacaatcgaacaattaggtcaagcaaacaaggttacggttactaaggacgacacaaccatcgttgaaggttctggtagccaagaacaaatcgctgaacgggttgcaatgatcaagcaacaaatcagtgaaacaacttctgactttgacaaggaaaaacttcaagaacgtcttgctaagttagctggtggggttgcagttatccgggttggtgctgctactgaaaccgaattgaaggaaaagaagtaccgtattgaagatgctttgaacgctactcgtgctgctgttgaagaaggattcgttcctggtggtggtacagcacttgttaacgtgattgcttccttggaagaccttgacgcagaaggcgacgaattaacaggtatcaacatcgttcgtcgtgctcttgaagaaccagttcgccaaattgctgaaaacgctggtgaagaaggttccgtcatcgttacaaaacttaagacacaaaaagatggtgttggttacaacgctgcaactgacgaatgggttgatatgattgaagctggtatcgttgacccaactaaggttactcgttcagcacttcaaaacgctgctagtgtatccgcattgttattaacaacggaagcagtagttgctgacttaccagaagaaaagccggcagctccagcagctccaaacccaggtatgggcggaatgatgtaatcaaactttcgtgactgatggagatgcttaccgaaaatggtaaaccatccccgcaattaatcactgaaggcaactgaataatccaggaaaagacgcgcattgcgcgtctttttttgtgtccaaatgccggggtaaagggttatcgcaaaatctctttaaaagttaatcaggaattttgttttatttgcctaaattctgttattatcagtatatgagtgagaatccaaaaatatgctagctaatttactggttttggagtagaatttcacttgcatatttttaaaaacggagagtaaaaaatgttttcgtatttgaaacgtattttaattggtaaaccactgaagacgttagacgaaagtggccaagcgttaacgaaatttaaggcgctcgctctgctatcttcagatgctttatcatctatcgcatatggtaccgaagaaattctttcggttttaattgttttatcagctgcggcaacttggtattcgattccgatcgcagcaatcgtgttagtgctattatttgcaattacggtgtcatatcgtcagattattaaggcgtatccttcgggaggcggtgcttacgtagttgctagcaagaactgggggacttcggccgggctagtcgccggggggtcgctgttagttgattacatgctgacggtggccgtaagtgtgacttccggaaccgaagcgattacctcggcgattccggcgttacagaagtatcacgtggccatcgcggtgctgattgtgctcggaattatggccctgaacttgcgagggttgcgggaatcggcaagtttccttaccatcccggtttacctgttcgtagtggtaatctcgataatgattattgtggggttatataacatcgttaccggacaagttacttatcatgcggcagcagcaattggctcgaccgtgccgggaatgaccttcgtgctcttcatgcgggcgttatcttctggatcatcttccctaactggggtagaagcgattagtaacgcggtgcctaatttcaagaaaccgcggcggaaaaatgcggcagctactttggcaatcatgtcgttgattttggcttcgttcttcgcgggaattacgttcttagcttactacagcggaattacgccgatgagttcgcaaaccgtgctttcccaaatcggggttacggtcttcggccacgggattttctactatatcctacaattgtcaaccgcgttaattttggcggtagccgcaaacaccgggttctcggcctttccaatgttagcctacaacttggccaaggataagttcatgccccatgcttacatggatcggggcgaccgactcggctactctaacggaattatttcgttagctgcgggcgcaatcgtgctgattttgattttcggtggacaaaccggtctcttaatcccgctttatgctattggggttttcgtaccgttcacgttgtcacaatccggaatgatcgtgcattggaaacgagaaggcggcgctcattggtggataaatgcttctgctaacttactaggagcgttactgtcggcagtcttagtagtctgcttgctattcctacactttagcaacgtttggccatactttgtggtcatgccactgttattgcggatgttctacaagattcgtaagcactatgacgaagtcgctgaccaactgcgggttgtggaaaagggcaaggttaacttgcatgactatgacggttcaaccgtaattgtgttggttagcaacgttacccaagtaacttctggcgcaatcaactacgctcggtcaattggggattacgtaattgccatgcacgtttcgtttgatgctaacccagaaaaagagcataagacggcgatggaatttaaagcggaatatccggatgttcggtttatcgacattcactcgtcgtaccgttcgattaccaatccgacgcttcggttctgtgacgtaattgctaaacgggcggcagaacggaattacaccacgacggtattggttccgcaattcgttccccgcaaaccatggcaaaacattttgcataaccaaactggtttacgattacgggcggcattaaattcacgcgaaaacattattgtttccacgtataattatcatttgaaataaaagtaaacgggttaaggaagtgagcttccttaacccgttttttgtgcaaagactccgggaaaagcttcgttgaagtgaatagatgttatttttctgtggaaacgttgtcgttttaaaatgaaaattatcgttaaattatgtgagttttcggtgaagttactgtataaggcatgcaaatttcggtataatgagcttattatgaacataaaagaggacaaattatgcgatttgaaatagttgtcagtttatttgcaaccatgatcatttcggcgattttaacaccatttgtccgaagaattgcttttaaaattggagcggttgataagccgaacgctcggcgggttaataaagtgccgatgccgacgatgggcgggttagcaatcttcttggcatttaatttctcactttttttcttactaagaaatcaaattcctaacccgcaattttacggaatcttcttcggcgaatgtataattatgttaaccggaattattgatgatatttttgaattaaaaccttcgcagaaaatgattggaatcttactcgcagctttagcggtgtattggtttgcggaagtgcaaatgacgaccttgactttaccgtttattgggattgtccatttgggatggttttcgttaccaattaccctaatttggattgccgcgattactaacgcgattaacctattggacggtctagacgggttggctaccggggtcaccatcattgcgctatttacgaccgggtttaccggattgttctttttaccatccactaatatttacattgtaattatgatttttacgttagtggctgcagaagtgggctttttgccatataatttcttcccggcccgcatttatttgggggataccggggcgttatttattggatttatgattgcggtcttttcgctttcaggattgaaaaacgccaccttcatttccgtcttaatcccggtaatgattttaggagtgccgttaaccgacacaatttacgccattttgagacgactgctaaataaacaatcaattgcgcacgctgataagcgccatttgcaccaccgtttgatgcaaatgggattgacgcatcgacaaaccgtgttggtaatttatggtatttcaatgattttttcctttatcgcgttgctctacccgctttctacattgtggggctcggtattgttgacgatcggaattttagtgggaattgagttgtttgtggaagcaatcgggctagtaggggaaaatcggaccccgatgctaagctggattaaacgattagttcggaccactacttctaaaactgctagcaatgaatttaaagaagaagatactttaaaagatcgagtgcgttcgcgtagtgaacggcaccaacaaaaaaagcatcacgactgatgcagtaatccctaaaagttagattttggagatactatgtaaggcgtgatgcttttttgttaaataattactgaggttggtatggaacttgaacgcgttgttgtccgccgtctttaaagctaacgttgccactaaagagtccggttagttctgcctttaaatcggccacttggtcttggtcgacggctacggtggtgattacctgggtggtatactcgtgattcacctgggtaatttggtgttgttcgaggtagtaggttaactgatcgttattttggtaatcaatggtgattgctagcaattcttggtctaccgattccattagggtagcagattgcacagcaagagaagtactcgatccgtaagcccggatcaacccgccggcgcctaatttgatgccgccgaagtaccgggtgaccactaccaaaacgtttgttagattttcgcgttttaaaacttcaaggatgggcgcgcccgccgtgccagaaggttcgccatcgtccgaagctcgttgaatatcttggtggtctccaagcacgtaagcaaaacaattatgggtagctttagcttcgatttcacggatatcttgcagtttagtttgggcttcttcttcggtttgtaccggaataatccggctaatgaaacgggatttcttaatgtcttgttcagtgataaccggttctttgacggataaaattaatttcaagaaaaggtctcctttttaagtatcttatagtatggaagcaaaggttaaagaaaaatattacggccggctagtaccggttaatcaggcggaagctactgatccaacggttaattattttccagccgttatcgtaaaaaaacggcggatccaatgtcagcgctgtggagcgactaccaaattaaaggagggcagcttacccaaccagcagtattattgtcgacactgtataaatctcggtcgaatgtccacattggttaagttaggaaacttgcctgaaccgaatcactttcctgtgggccgttcgtatttaaagtggcaagggcagctaaccccggaccaacagcgttgcgccaacgaaattatttcgtcaattaaacagcaaacggatcggctgctgtgggccgttacgggggcgggaaaaaccgaaatgctttttccgggaattaactttgcgttaaaaaaggcgctccgggttgcaattgcctctccacgtatcgatgtagttttagaactgcacccccggattcaagcggcgtttccggaaattgcgatcgcattattacacgggcgcacttccactccctatacgtatacacagttagttttatgcactacgcaccagctacttcgattttaccacgcctttgacgttttaatcattgacgaagtggattcgtttccctttgcaatgaatccagcattacactacgcggcgcaccaagcgcgtaaggagtgcggtacgaccatttacttgacggccacgccagacggtcaattgttaaaggatagtcggtcccaccggttgcctactagctatttaacccgccggtttcacgggcacccgctaccagaaattaaaatggttagtgggtgcaattggcaaaaattaattcaccgccggcggcttccggaacgactacgccaatttctaatggctcaagcaaaggcacagcggcaatttttagtctttgttccgcgaattgaccagttgtcttcagttttgcaggccattcaaaaacaattcccggagcttgatttagcaacggtgtacgcagaagacccggaccggattgagaaggtttcagcaatgcgggaaggtcagcttaccggtttaattacgaccaccattttggaacgcggggttacctttccgggaattgatgtagcagttttaggtgcggatgatgaaatcttttccatggctgccctcgtacaaattgctggaagggtcgggcgcagtcctaaacgaccaaccggaaccgtcttatttatcggccaaatgttaacccgccggattaaaagggcccaacgccagattaaatttatgaaccagcaggcctttaagcaatgaaccgctgtttattatgcagtcgaatgctgaatagacgagttgacctatcctttatccttagctttcaacgggcgcaaccgcagttgctttgtcacaactgtcgaaaccagttagttaatttgcaggagcgtaaagtttgtgtaagctgcggacgactagctaaccagttacaatgctcagattgccaaaaatggaatgaccaatttaacaatcaagcactttttcaatacaacgcgttcatgaaggaattttttcagcgttataaatttcagggagactactggttgcgtaaagctttttgcaacgattttatcaattttattcaaagtttagttaaagaagatgaacatttagtaccaattccggtcgatcaaggtacaataaaggtacggggatttaatcaggtggcggggttaatagaaggtctggaatttgagcccgttttaattagccaacgctctgaacaagcccgccatcagtttcaacgtagccgtcgggaacggttgcaacgtgaaaatcctttccgggttgttgaacctaataaagtcgccggagccaaatgggtaattattgatgatatttacaccactggggtaaccgttcgccaagccggacgggagcttagtaagcatggtgcgcgtcaagttcgttcaattacgctttgccgatagtttttgagtgtattaattgtttattatagcgttttcatttataatataagtgtacagaaatacatgaagtaaaacttatatttctgcacgtggacgcactttgttcacagttgaaaggagagagtcttatgcttgattttaatgtacgtggtgaaaatattgaagtaacagaatcaattcgagattacgttgaaaaaagaattggtaaaatcgaaaagtactttgaccaaggtgctaacccaaaggcacacgtaaatttgaaggtataccaagatcggacagctaaagtagaagttaccataccattaccatacttggtattacgagcagaagagacatcgcctgatttgtacgcaagcgtggatttagtaacggacaaattagaacgacaaattcgtaaatacaaaactaaaattaatcgtaaatcacgggaaacgggttataagggagttgaaatcccacaagaagacgcacgtgaagacgaagaagaggccagtgaatttgatattgtgcggactaagcaagtatccttgaagccgatgggggctgaagaagcaatcttgcagatggacatgttaggccataatttctttatttacgaagacgctgatacaggatcggttgatattgtttatcggcgtcacgacggtcgctatggtttaattgaatccgctaacgaataattgtgaatgttaaaaataaggattgcttaatagaccacacatggtttgttaagctttttttgatgaactttgataatatagaaaaaaatgataaacttagacaagtttatcgtggacacgatttagaagagtacggaaggaattatacatggcaaacattttaaaaaaatgggttgaaagtgatgcccgtgaaatcaaacggctaggaaaaaaagccgacaaaattgatgcccttaaggatgaaatggcacaattaagtgacgaagaattaaaggcaaaaacgccagaatttaaggaacgtttaaaaaatggggaaaccctcgatgatattttaattgaagccttcgcggttgcccgggaaggtgccaaacgcgtgttgggactattcccttttcgggtgcaattaattggtggaatggttctccatggcggaaatattgccgaaatgaagactggtgaaggaaagactttgaccgctacactaccagtgtaccttaacgccctaggcggcgaaggggtccacgtagttaccgttaacgaatacttagcggaacgggactctactgaaatgggtgagttatacaagtggcttggtttgacggttggggttaacacggcagaaatgtcccctgacgaaaaacgggaagcctacaattgtgacattacctactccaccaatagtgaaatcgggttcgattatttgcgggataacatggttgtgtacaaggaagatatggtacaacgaccattgaacttcgcgttaattgatgaggttgactcggtattaattgatgaagcccggactccgttgattatttctggacaaactgaaccttcggttaccttataccaacgtgcggaccgcttcgtgaagacccttaccgatggcgattacacgattgattgggaatctaagtcaatttcattgaccgaaaacggaattcgacgtggtgaaaagtatttcaacacggataatttatacgatgtagaaaacagcgccttgaatcaccacattgaccaagcacttcgggccaactacatcatgaccaaggataaggactacgtggtctctgatgatggtgaagtactaattgttgattcgtttaccggacgggtcatggaaggccggcgtttttctgacggtcttcaccaagcaattgaagctaaggaacacgttgaaattcaagatggttccaagaccatggctaacattacctaccaaaacttgttccggatgtataagaaattatccgggatgaccgggacggcgcaaacggaggcggaagaattccgcgaaatttataacatggaagtgattagtgtaccaactaaccggccagtagtccgggacgaccgccctgatttactatacccaactttggaaagtaagtttaaagcggtagttaaggaaattaaaaagttgcatactaagggacaaccggtgctggttggtaccgtggcggttgaaacttccgaatacctatcccggttattagaccgtgaacggattccgcacgtagttttgaacgcgaaaaaccacgctcgcgaagctgaaattgttgctaacgcgggccaaaagggtgccgtaaccatcgcgactaacatggctggacggggaaccgatattaaattgggacctggtgtagtcgaactcggcgggttagccgtaatcggtaccgagcgtcacgaatctcggcggattgacaaccagttgcggggacgttctggacggcaaggtgacgtcgggatgtcacagttctacctttcactagaagacgacttgatgattcgctttggttctgaacgaattaaggacttgctttcccggatgaaggttgcggatgaagacgcggtaatccaaagccgtttgattagtcgccaagtggaatctgcccaaaaacgggttgaaggtaacaactacgacgcgcggaagaacgtcttacaatacgatgacgtaatgcgggcgcaacgggaagttatctacgcggaacggcaacaagtaattatggaagaacacagtctaaaagatgtgctaatgccgatggtttaccggacgattgaccgggtggtagacgcgcatacggccaagacgaagaagagttacgacctagatacgattgtggaatttgcccggaccaccttggtaaacgaaaatgatattaacattgaggacttagaaggcaagtcggctaacgaaatcaaggattacttgaagcagctagcagaccagatgtacaagcaaaaggaagatgcgttgtacgcgcctgaacaaattctcgaatttgaaaaagtagttatcttacgagtggttgaccaacactggaccgaccacattgacgcgatggatcaattacgtcaatcagttggactacggggttatggtcaattaaacccactagttgaataccaacaagaaggctaccggatgttcaacgaaatggttacggatattgagtacgaaactacccgactcttcatgaagtcggaaattcgacaaaaccttgaacgttagtagctttataatataaactggggaggcggcaaagctgacccagttttttagttaaaagaaaaaaggagtagatgaaatggagctaacggacgcaaaacatcaaattgaagatatgcaaaaagaggtcgctgacttcgggaggtctctttgacttagatgcgttgaacgaaagcatcagtgttaacgaggcaaagatggcggaacctgatttctggaatgatcaggaaaaagcccaaaaaataattaatgaaactaacgtattaaaagctaaatatgacaattataaaaatttaactgaccatgtggaaaacttagaagtcaccctagaactattagaaatggaagcggactccgacgtgcaggcggagtttgaagacgaactttcccaaacggccaaactgttgcgtgactaccggttagggctgttgctgaatggcaagtacgatgccaataatgccattttggaaattcatccgggagctggcggaaccgaatcccaagactggggctcgatgttactgcggatgtatacccgctgggcggaacagcaccaatttaaggtccaaattgaagattaccaagccggcgaagttgccggaattagtagtgttacaatacgggtgatgggccataacgcctacggctacctacgttcggaaaaaggggttcaccgcctcgtgcggttatcgcctttcgattcagccggtcggcggcacacctcgtttgcttcggtagacgtaatgccagaattagacgactcggtagaagttaacattaacccagacgatttacgggtggacgtttaccgctctagcggggccggcgggcagcatattaataaaacttcttcggccgttcggattactcatttgccaaccggaatcgtggtcgctagccaagcggaacggtcccaattgcaaaaccgggttaccgcgatgaatatgttaaaggccaagttgttcgagttagaagagcaaaaaaaggccgaagaaaaggctaagttagagggaacccagctagaaatcggttggggatcccaaattcgctcttatgtttttcatccgtattcaatggtcaaggatcaccggaccaatttagaaactgcgaatgtgcaaggtgtgatggacggcgatctggatgactttattaacgcttatttacaatggaagttgcagaaacgtaatcctaaataggagattttttcatggcaatgacaattttagtggtcgatgatgaaccggcaatcgttacactcttaacgtacaatttaaaacaggctaattatcaagtgattagcgtagacaacggggttgatgctgttaaagtagtgcaacgcgggaaggtcgattttgtgattatggacttgatgctgccccagttggacggggtcgaagctacgaaacaaatccgtaagttcaacgaacaaattccgattattatgttgacggctaaatctagcgaagtggataagattttaggactagaattaggggcggacgactacttaaccaaaccgtttagcccacaggaattaatttcccggattaaggccattttgcgacggactaaccgggtggtcgacttaaaggaaattgtccctgaattacctgctaccggaattacgattgattttaagcggctaacggtacaaaaaaatgggcaaccggtggctttaacacccaatgaatttcggttgttgaagtttttgtttcaaaatagtaaccaagttttatcacgggatcaaatcctcgaacaagtttggggatacgagtatggcgggcagacgcgcattgtggatatgcacatcagccatttacgcgacaagctggaagatgatccaaaacatccacggttgattaaaactattagggggttcggttatgagttcttcacaaaagaagggcattagaaaaaccatccagtttgggctagcaagtttgattgggaacgcgtttatggcctttctggtttataaattaattgttaaggaaaacccgcgggtcacccgggtcgacatgaccttaatgattgcggtaattttattgattaccgtgattgaagtgattgttttttggagtaaccaaaagaacatcattgagcggcaacaccagttccgaattaacctggaagagaccattaaagggaataaggttcctaaaatttacctggatccagacgaccccttttataaattatctaaggccgttaatgaaattagtaaacacgagcgacaccaaattcacgagttgaccaaccaacaaaatgaattaaaagcgattatggataacttaccggtgggagtgttagtaatcaatcgacaccgggagttacaggtggcgaatacttacgccattaaccggttaggaatcacggcgcttgatattccgcacccttacacgttagacgtgcgaaatcaagagctcagaaacttagttgaccaagttttccaaagtcgccaaagcgtcactaaaacactcgaactggaagacggcgggcaatcttatatttttgaaactaacgtagtttacagtcccaaagtgcaccacaagtttgaaattatcgtgttgctttacgacgtaactgaaagcgtacggtcgaaacgaattgaacaggattttgttaacaacgcctctcatgagttgcggaccccaatcacttcaattgctggatttgcggaaacgttgttggagggcgccaaagacgatcccgaaacgctggataactttttaaatattattaagtcggaaagtgacaagttagtgcgtctggcggacgatattttgaccatgtcccaggttaaaaatgaaccaaagacctggaagaaagttaacttgtacgcttacgtggaacagcaatttcacatgttacaaaacaatttacaagaaatgcagctgacggtggaaaataaaattccggaaacggccatggaaactgtggtagaaaacgaccttttccaaatcactaagaatttgattactaacgcgattagttacaatcgccatggtggaaagattaaggtcgaatacgcttcgcaccacgatagttgggaattgtcagttagtgataccggaatcggaattccgttagatcagtctgaacgagttttcgaacgcttttaccgggttaacaatgcggtgaagggcggaaccggcctggggttagccattgttaaggaagccgtcgtggatatgggcggtagcgttcggattgaatcggacgatgacgatagtggaaccaccgtcgtagttcggtttaagcgccgggtttaaaataataacttacacaattaaggtgtcggaaaattccgacgccttttttgttgactttgacgatgtaaaagtaagtttttgctcatggggatgtggataacttagctaatcttggcgttagtttcgacatctttacataatctttacattacccatatggaacctttacctagctttcataagctaagtatgtaagtaaggaacaggaaaaacgggaggttcgctaatgaataaatggcttaagttgctgcttagttgcggattaattttgggaattgggttacttgcgggttgccagaataaagatgccacccaaaaagtaaccattgtcggttcgactgcgttgcagcccttagtggaaaaagcggcggcagattatcaggtaactcacccgcaagcacagatcaccgtgcagggtggcggatcggggaccggacttggtcaagttcaacaaggagcggtacaaatcggaaactctgatgtatatgctgggcaacaagatgggattcgagctagtcaattaaaggatcaccaagtggcggtagtcggcattgcacccgtggtcaataaagacgtggggattaagaatttgtccatgaccgagttacaaaaaattttcacgggaaagatcaccaattggaaacaggtgggcggcccggatgaaaaaattgtgataatcaatcgggcccaaggcagcggaatccggaaaacgtttgaacagacagttttaccgcatggtggcgcggtaaatgctcaggaacaggatgctaacggaacggtgcaaaaggtggtacaggcaactcctggggcaatcagttatctgtccttttcatattttaataagcagttacagccaatcgcgatcgacggagtacaacccaccgcggaaaacgtgcaaactaaccggtggaaaatttggtcgtatgagcacatgtacacccagctgaaaactaactcagcaacccgagacttccttaagtacatgacgtcccagacggtacaaaaaaatttagtgagtgatttaggatacatttccattcatgatatgcaagtgaaacggaccatggacggaaaagtgattccgatcaggggggagcaaaatgattgatgaaattcaaaaggaattaacccaaaagtcacaagccgcgcggcaagatcaattgggcaaattaatcgcccggatttgtgtgggagtaattatgctagtagttctagcaatcttattcatgatcacttccaaaggcttagcaactttttcagaaaacaaaatcagtgtaggcgattttttcaccaaaacaatctggaatccgactgctaagccgaccccgttagtgggcgcattaccgatgattgtcggttcttttgcagtaaccctgggctcggcacttttggcagcgcctttggcaatggcaacggccatcttcatggtggaaattgcaaacaaacggcgtcggggccttcttcaagcggtaattgagttactagtgggaatcccatcggtagtttacgggttcgtcggcttaacggtggtggtccccgctctccgtagtattttcggtggaaccggttttggaatcttagccggcgccctggtgttattggtaatgattttgccaaccgtaaccgcaatgtacgtggatagtttacaagcagttccccgtcactatcgggaagcttccttagcgttaggggcaacccgttggcagacaatttctaaagtagtggtgcgtgcttccttacccgggttgttaacggcgattatttttgggatggcccgtgcctttggcgaagcactcgcggtacaaatggtaatcggaaacgcagcggttttgccaaaagacgttttgactccggcggctacgttgactagtgttttaacgactggaatcgggaatacagtgttggacactttaccaaacaacgccctgtggtccttagctctggtactgttgataatgtcactatttttcaacctattaattcggatgattggcaaaaagggggcgtttaaatgaaggcgaaacgaattgaccggattgcaaccggggtaatttacgcaatggtgggattggtcgttttaatcctaattgggttgctaggttttatcttaacgaccggattaccacacgtatcgtggcgatttctgacatcttcggcggccgcctttagtgcaggaggcggcattggggatcaattgtttaactcattttatttattggtgctaaccctgatactatccttaccgattgcgttaggagcagcaatttatttaaacgagtatgcgccccaaaataaaattaccgaaattatgcgaatcatgattgaagtgttgagttcgttgccttcggtagtggtcgggttgtttggcttcttacttttcgtggtgcagtttcaactaggattttccattctttcaggtgcaattgccctaacgttattcaatttaccactgttaacccgtagcattgaaaatgccttggcaggggtgcctgatttacaacgagaagcaggtttagcgttggggatttcccggtggcacacgattaccagggtaattctaccagctgccttacccgggattttaaccggagtaattctgagtgcgggacgggtgttcggggaagccgctgcactaatttttaccgcgggacaaagcgcaccaagtttaaattacgccgattggaacccgcttagcagcactagtccactgaatatttttcgaccggcggaaacccttgccgtccacatttggaagattaacacggagggaatcatgcccgatgctagccaggtatctgcaggagcttctgcagttttgattattgtaattttaatatttaatttcagcgctcggcgcttaggtaactgggtataccggcgaattactgcgagccgatagggggatgaatgcaatgcaaaccaacgttaatgaaagttcaatcttaaggtttccaactaaccgtgaaattgcactggaaactcacgatttacaggtattctatggggaaaagcaagccctttttgacgcctcgctacagttcccccggtattcaattacagcgttaattggtgcctcgggatcgggaaagtcgacctacttacgcagcttgaaccggatgaacgatggcattgcgcgagtaaccggtagcattacgtaccgggggttagatattaatacgaataacgttgatatttaccaaatgcggcgccggatcgggatggtttttcaacgtcccaacccgtttgctaagtcaatcgaacgtaacatcacctttccattacgcgagcatgggataagggattccgcgcaactagctgaagtgaccgagacgagtttacgacaagctgccctgtgggatgaagtgcatgaccgcttaaatgcaagtgccttagcactctcgggcggacaacaacagcgcttgtgcattgcccgggcgttggcgatgaatcccgacattctactgttagatgagccggccagcgcgctagatccggtgtcgaccgctaagattgaaaccacgctgcgagaattaaaaaagcggtatacgatcatcatcgttacgcatagcatggagcaggcgtcacgattaagcgattatacggcgttcatgcatttagggaagattgtagaatttgatacaaccaagaatatttttaccaatccccgtgaaaaattgacggaagactatatttcaggaaactttggttaaaggagaagggtaatgagtaataacgtggtaactgcagaagacgtgcgcttatcttatgggaaaacggaggctttacacggaattaaccttaacttgccaaaaaaccaaattacggcgttaattggtccgtcgggaagtggcaaatcaacctttttacgttgtttgaaccggatgaacgatttaattccggaagtgcgggtgaccggaacgattcgggttgcggggcaggacatttacgatgctcaaactgacgaagcggatttaagacggcgggtcggcatggttttccaacaacccaacccctttccattttcggtttatgacaacgtcacctacgggctccgccttgcgggaatcactgactcccaagttttagcggaacgggtggagacgagtctgaaacaggccgcggtttggcaagaaactaaagatcatttaaaaagcaacgccctttctttttcgggcgggcagcagcagcggatctgcattgcccgggtgttagcggttcaaccggaaattattcttttagatgaaccaactagtgcgctagacccgatttcggcggggaaggtggaagaaagtttggtggctttgaaagaaaattacacattagcagtagtgacccacaatatgcaacaggcctctcgaatttcggatcagacggcgttctttttaaacgggcagttagtggaagcggggccaactgctaaactatttttaaatccggatcagacggcaacgagtgattacttgaacggtaaatttggttaagggggaattggtatgcaaggaatttttaaggaagagcttaagcggctattagaacagttcacggaaatgggactggacgtgggggaacaaatttatcaggcaccaaatcttttattgaccacgatcgtgagctagctcagtccgtgattgaacacgatgaaaaggtcaacgttgccgaagtgcggttagaagatcaggcaattaatttgatggcgctgcaacaaccagtggctaatgattttcgacaggtgatcgtagttttaaaggcgagttcggaactggaacgaatcggcgaccacgcggtggggattgccaaggaaacgatccgaattaaggggcatcagcgggatgcaataattgaagcagaaattgctgaaatgacccatttgattcgggggatgcttgacgcaacgattgacgcctacgttaaggatgacggccggcttgcaaaagaaattatcgatgcgaaccaccaaatcgaaaccagttttaaaaaaattcggcaaagcattgccagtaaaatgaaacacgacgccaaagtggtgactggagggaccggatatttaatggttgctagctatttggaacggattggcgaccacgtaattaacgtggtggagtggatcatgtacaaccagactggaaagattacggagttatccggggacaattaaaaataaacgggtggaggctgggaaaaaagtaaaaaatgcttttcaaggataaaaaggtccttaaaaagttgttttgatgttttgacttcaatagagccaaaacgtgtgccaaaagccagtttgttccgcttaaccaaaaattgaccatgatgccaaatccaggcatcatggtcaattttcagttaatgctcacaaactacccgacttttgtcccactctcgcttttttatttttatcatggaaaataacataagatgtgctgccttttaggggattaatttaaaattttggtaatacccgtactttttatggggataaagtttgctaatcgaaagtgaaaagctgtaaaattacagataattaaaaagcttagaggtgaaatgtttgaaatcaggtttcaaatcaaagtttacaaagtctaacgaccgttttgttgctggagtatgcggtggcattgcggaacattttggctgggataagtcccttacccgaatcattgcgttagtactaattttactatcacacgggttgttgttgatcccatactttattttagcttggtacatgccaagtcaaaatatgggattctttcagcagtttgccaactggactgacttttcgggaaaaactcccggacaaaagcaatcacggcaaagaaaagaaattaaggacgccgaagtacacgacgtcgatgaataaaagattaggagaatgcaaatgcgcttttggcaacgagtattagtgaatggaattttatttgtcgctttaacgggatttttccaaaatagcggaaatttctacgtttctaacatttggattgcgttagcggcaagcctcgtcttggcgattttaaatgctagcgtgcggccagttttacaaattatttcgctaccaatcacgttattgaccttaggatttttcagcatcgtgattaacgcgttaatgctgacgttcacgtcggcgctggttggtcccgctaacttctatttttcgtcattcgggatgacgatgttgatctcggtgattttgtcgatttgtaacatgattatttcgaatcatttttccaatcgttattaaaggaggcccatcgtaatggccgatagtgtttcaattacagaattagttaaaaaaattaggctcgatgtattttatggggaagacctgttagataaaaagcaggttacggttagtgacatttcccggccgggattagaattaaccaattactttaaattttacccccgcgagcgaattcagttgtttggccaaaccgaaatttcgtacgcaaaggatagcatgacgagcgcggatcgcacggttgtctacagccaaatggcagataagcaaacgcccgccttcgtaatttcacggggacttccggtgcctaaggagttaattaaggcggcaaaggataacggagtgccgattttaacgtcgacccttccgacttcccggttgttaagtaacatgactaactacctagaagaccgtttagctgaacgggattcggttcacggtgaacttgtggaaatttacggactaggggtactgatcaccggtgattccggaatcgggaagagtgaaactgctctagaccttattaaacgcgggcaccggctgattgcggatgaccgggtcgatatttaccaacaagatgaacagaccttaattggggaagctccccaaattctccggcatttgttagaaatccggggagtcggaattatcgacgtgatgaatttattcggggctagttcggttaagaacagtaccgatattaacctaatcgtccacttacaaaattgggataaagaaacccattttgatcggctcgggaatggtgaacaaacccggcatttctttgatttagacattcccaaaattacgattccggttcgtgttggacggaacctcggggacatcatcgaagccgccgcaatgaactttagggctaaaaatatgggttacgacgctacgaaggttttcgaccaaaaccttaacgcgttgattaaagataactcacaagcataggaagtggatttagtgaatttaagtatcggagctttaaatccgattgcattttcgtgggggagcctccaggtacactggtacggaattatcattgcctctgccgtggtcctggcaaccattctagcggttcgggaagcgcgacgccggcgcgtggatcccgatcgcatctatgatttgattttatggtcgctaccggtggccattattagtgctcgcgcctactacgtgatttttgaatggggttactaccaaaaccacctttccgaaatcattcgggtttgggacggtggaattgcgatttacggtgcgttgattggtgcgggaatcgtggtttacctattttgtcggtactactggattccggtttggttgatgttggatatcattgctccggtgctgatcatggctcaaggaattggccggtggggtaactttatgaatcaggaagcctttgggcgagtgaccagcctagcttttctgcaaagtttacacctgccgcactttattattcagcagatgtggatcaacggcgcgtttcgccaaccaaccttcctgtatgaatccgtatgggacattttaggctttattgtgttaatgagtttacgtcacgtaccgaaactttttaaacaaggtgaaatctttttgagctacgtgatttggtattctttcggacggttcttcgtggaaggaatgcgaacggatagccttatgttattggggattcgggtctcccaatggttgtcggtagtgttatttatgggcgcgattggcctgttgatttggcgccgaacgcgggtccaaaatccggttcccgactacctggatggaaaccagttcgcaccaaaagaccttgagtaaagtacctttatatatgataatgagagggtacatatttttaaataattatattttatagattgtaaggggattaataatggcaaaaaaagttgcagtgttaggagccggttcatggggcagtattttagcaaacatgttggttcaaaatggcaatgatgtagttgcttggacaaacatggaggcgcaagctcaagagcttaacgaccaacacactaacgagcattacgtgccaggtttcaaatatgatgaacgtttagtagcaacgacggatctagaatttgcgttgaaagacgttgatgcggtgttattcgttgttcctactaaggtaatgcgcttagttgctcaacaaatggttgccgttttagaaaaaacaaagcaacaaccagtaattattcatgcaagtaagggacttgagttaggaactcacaaacgactttccgaagttttggaagaagaaattccaagccagtaccggaaggcgatcgtggtcttgtctggcccaagtcatgctgaagaagttgctaaacaagacttgacgttggtaacggcggcaagcactgatttagcaagtgctgaaatggtccaaaaattatttatgaaccactatttccgcgtttacaccaatgacgacatcatcggcgtagagatgggagcggcgttgaagaacgtcattgcgattggcgcgggtgctttacacggccttggatacggggacgatgctaaagcagccctcattacccggggattagctgaaatatctcgtttaggggttgcctttggcgctaaaccgctaacctttattggtttatccggggttggtgatttgattgttacggctacgagtgttcattctcgaaactggcgggctggtaacgaacttggccaaggaatgcagctgcaagaagttatcgatacgatggggatggtcatcgaagggattccttctaccaaggcagcttacgaattagcccaacaaaaacatatcgagatgccaattactgaagccatctacgatgtgttgtataatgataaaggtgttaaagaagtcattgatgaccttatgcaccgggatggaaaatcagaattagagtaaatatttggaggtttgagtttttatgacaaaagtacgtaaagcaatcataccagcagcgggattaggaacccgattcttaccagtaactaaggcttcgcctaaggaaatgttaccaatcgtggacaagcctacgattcaatacatcgtcgaagaagcacggaagtctggaattgaagatattttgatcattaccggaaaaggtaagcgggcaattgaagaccattttgacgcggttcctgaattggaagctaacttaaaggcaaagggcaagaagcaaatgttaaagatggttgaagaaaccaccggtctgaacatgtacttcaagcggcaaagtcatccccgtggtttaggggacgcggttttaactgcgaagacattcgttggtaacgaaccatttgtcgttatgttaggtgacgatttgatggaagacaaggttcctctaactaagcaactggttgattcgtttgaagatactggtgcttctacattagctgttttaccggttcctcacgaagaagtttcgaagtacggggttattgatccatctgaagaagtggaaaagggcttgtacaacgtttctaagtttgtggaaaaacccgcagttgatgaagcaccaagtaacttagcgatcattggtcgttacgtacttactccagaaatctttaacattctcgaaaaccaaaaacctggtgaaggtaacgaaatccaattaaccgacgcaatcgatacgttaaacaagaagcaacgggtgtttgcgaaagtatttaacggtgaccgttacgacgtgggtaacaaatttggtttcttaaagaccaacattgaatatggtttgaagcatccagaaacaaaggatgaacttaaggcctacatcaaggaattagctaaaacgctcaaataaaaattagcatagctatttaggggagactcggacttttggtcccgggctcccttatttattttctaagttgcttggtgacttgctaagcattaaaaatgcaatttttaaattagtgattataatacagaataatggacagttattaaaagtaagtgtatagtggattcattatcagatatggaggattattatggcaaagcaatatgatgtgatagtaatcggtgcggggccggctggaatgaccgcggctttgtatgcatcgcgtgctaatttgtcggtgctgatgcttgatcgcgggatttatggcggccagatgaataatacggcagccatcgaaaattatccgggatttaagtccatcctgggaccagatttagcaaaagaaatgtacgaaagctccactcaatttggcgcagagtacgcttacggaagcgtcgaatcaattcgtgacgatggagccactaagttagtgaagaccgatatgggtgaagaatttatcggcaaggccatcatcattgggaccggctcagaatacaagaagctgggcgtgcctggtgaagaagactttagtggccggggagtttcctactgtgcggtatgtgatggtgctttctttaagggaatgcacttgatcgtggtcggcggtggtgactcagcgattgaagaaggtatttacctaactcaattggcatcgaaagttactgttattcaccggcgggaccaacttcgggcacaaaaaatcagccaagaccgggcgtttgctaaccccaagatggaatttatttggaacagcaacgtaaccgagatcgtgggcgatgataaggttatcggcgtaaaggttaaaaataaccaaactggtgaagattcttttattgaagctgcgggagtatttatctacgttggggtaaagccaatgaccgctccgtttaaggacttgggcattttagatgaaaacggctggattccaaccgacaacctaatgcacaccaaggttccgggaatttttgcagtcggtgacgtacggaagaaaaaccttcgccaagttgctacggcagttggagaaggtggcacggcgggacaacaagcttacgagtacattcaatcgttatcctaaaagtgtgaagtcattaatcatttaagaaaattatgaagcctccagaagccagggaaaaccttggtttctggaggcttttttggtgaactggagtggtttaataattaaaaacttttttatggattagctgtactttataattataggtaatggcagagtgcgatttttgggtaaaaacgctttctgagtgactaatcgtattgtataataaaaattaagttactcacaccgaggaggaattttttaatgaactgggaagattcagttaaagaatggcaagattttgccgatttagattttaacttaaaacaagaattaaaagaattagcaaaggatccacaagcgctaaaagaggctttttatgcaccgatggaatttggaactgcaggaatgcggggagtaatgggtccgggaatcaaccggatgaacatttacacggttcgtcaagcaacggaaggtttagctaacttcatggacacgctaaatcccgaagacaagcaacggggagtagcaattagttttgactcccgttaccattcgcaagaatttgctttagaagctgcgggtgttttaggcaaccacgacattccaacgttcgtgtttgatagtatgcggcctactcccgaactttcttttacggttcgtgaactcgatacctacgctggtattatgattacggctagccacaaccctaagcaatataacgggtataaaatttacggtccggatggcgggcaaatgccaccaatggaatcggaccggattactgaatacattcggaaggtcaccgatatttttggcgtaaaagctttgacgcaaggccaactccgtgaaaagggcttaatgaccttgatcggcgaagatattgaccagaaatatcttgcacaagtaaagacggtttccatcaaccacgaccttattaaaaaatatggcgcagatatgaagttgatctattcgccacttcacggaactggaaaggtagtcggcggccgtgcccttgaaaatgccggtttcaaagattacacgatggtaccaaagcaagccattgcggatcctgaatttggcacaacaccattccccaacccggaatttgcccaaacttttgatttggcgattgagttaggtaaaaagcaacaggcagacctcttgatcgcgacggatcctgacgcggatcggctaggtgcggccgttcgtttaccaaatggcgattacaagttattgaccggaaatcaaattgcggcggtaatgctagaatacattttaaccgcccacgatgaagctggagacttaccaaagaacgctgcagccgtaaaatcaatcgtttctagtgaattagcaacccggattgcagaagctcatggcgtagaaatgattgacgttttgaccggatttaagtacattgccgatcaaatcaaacattatgaagaaaccaacgaacacacctttatgtttggctttgaagaaagttacggctaccttgttcggccatttgtccgagataaggatgctattcaagggattgtactattggcggaaattgccgcttattaccggagcaagggccaaaccctttatgatggggtacaaaacctcttcacaacgtatggctaccatgaagaaaaaaccatttcaaaagacttccctggtgtggatggtaaagcgaagatggcagcaatcatggaaaaggttcgtgaagaacgcccagaccattttgacgacgttgcggtggttgaaacccaagacttcttaagtcaaactaagtacgcagataatggcgaaacttcgccaatcgaattgccaaaggcggacgttttgaagtttaagttggcagatggctcatggattgcgatccgcccatccggaacggaaccaaagattaagttctatatcggagcggtaggcgaaagcgaagaagcaaccttgaagaagatcgaaaactatgaaaaggcgattgatgggttgataaattagagaatggaggccagcgggtaatttttgaggattaactggattttaggtttgattgcggtttgagcgatcgaacctaaaatttggttaaccggaaaaaattgctggccggaattcgtcttggctatgcggcagttgagcacaaggattaactgaatatcgggactaatcgcggtttgagcgattggtcccgatatttggttaaccggagaaaactgggtaccggagcacgtttcggatatatagcagtgaagcgcaagtttaactggattttaggtttgattgcggtttgagcgatcgaacctaaaatttggttaaccggagaaaattgctggccggaattcgttttgactatgcggcagttaaccagagaaatctgggtaccggagcacgtttgaacttatccatcaatttgataactcgataagcaaagattcggctaacggccggatcttttttagttttcagctgttttaaaaggggtgctgagccaagtttgttccccgacggaaaactttcacattccagtttatttgtgatagtatgttaacaatttaaatttatttagggggaattttttatggggatgcatcaattttttaaaagtttaagtaatttagaaacaatttaccgggcacccggattttttaagtatcaaaaacattcggttgcggaacattccttcaaagtggcggaaattgctcaatttttaggcgacgtggaagaacatgcgggaaaccaaattaattggcgtttactttatgaaaaatcccttaatcacgactataacgaacggtttatcggcgacatcaagacgccggttaagtatgccacggctgacttgcgaaagatgctggcgaatgtagaagattcaatgaaggataatttcattaaaaatgaaattcctgctgaattccaagctgcttacgaacggcgtttgtcagagggcaaggatgacacgatcgaaggccagattttagcggtggcggataagattgacctgctttacgaatcgtttggtgaaatccaaaagggaaatccggaagacgtttataccgacatttataaggaaagcttaactacgattgttaaatataaggacatgccgagtgtgcaatacttcctcgaaaaagttttacccgaattgttaaatgaagagtttacggaccaactaaaattagaaaaaattagtcgcacaattattcaatagcaaaaaaatagcgaaagtatgttcggtgtgatagaatagtggcagtaactcaaacgttaataatcaaatggctgagagccagaacctaacggggttcatctcagtttttttgtgtgaatgggggaaaaataatgattgaacgcgaggaaaatcggcagttcgaactagtttctaagtaccagcccaccggagaccaaccgacggcgattaaacaactagttgatgggatccagaagggtgaaaaagaacagattcttttgggtgcgaccggaactggaaagacttttaccatttcaaacgtaattcagcaggtcaacaagccgacgctgattttatcacataacaagacgctcgctggacaattgtatggtgaattcaaacaatttttcccaaataacgcagttgagtattttgttagttattacgactattaccaacccgaagcatacgtgccttctagtgacacttatattgaaaaagattcgtccattaacgacgaaatcgatgaactgcggcattcggcgacgagctcgctattggaacggaacgacgtgattgtggtggcctcagtttcgagtatctttggtttaggggacccgcgcgaatatcgcgaccaagccttatcactacgcgtggggcaagagattgaccgtaatcaattactccgagaattagtcgacattcaatatgaaagaaatgacattgattttcaacggggacgtttccgagtgcacggcgacgtggtggaaatcttcccggccgctaacgaagcccactcaatccgggtggaattctttggcgatgagattgaccggatgcgtgagatggacgctttaactggagaaattattggtgaccgcgatcacatcaccattttcccggcaacccactttatgactaacgaagaccggatggaacacgctatcgaaggaattgaagcggaattaaaggaccggcttgcagaattagaaggccagggtaagttattggaagcccaacgactgaagcaacggaccacttacgatatcgaaatgttgcgagaaatgggttataccaacggaattgaaaactattcccggcacatggacgggcgcaaacccggcgaaccgccgtacacgctgctggacttcttcccagacgatttcctattggtagttgacgaatcccacgttaccatgccgcaagttcgcgggatgtataacggggaccgggcccggaagcaacaattaattgactacgggttccggttaccaagtgcgttagacaaccggccgttgaagcttgaggagtttgaaaaacatgttcatcaagtggtttacatgtccgcaactcctggggactatgagacggctaggacagatcacgtggtacaacaaatcattcggccaacgggattattggatccgactattgaagtgcggccgattatgggccaaatggatgatttgcttggcgaaattaaccaacgggtagaaaaagacgaacgggtctttgtaactaccttgacgaagaagatggccgaagacttaaccgattatctaaaggatatggggattaaagtggcctacctgcatagtgacgtaaagacgctggagcgaactcgcattattcgtgatttacgactgggcaagtacgacgtcttggtcggaattaacctgcttagggaaggaattgacgttccagaagtttcactggtggcaattttagatgccgataaggaaggcttcttacgtaacacccgttccatgattcaggtggctggacgggcggcacgtaacgaacacggacacgtaattatgtatgccgaccacgttacccaatctatgaaggaaaccatcgatgaaaccgcgcggcggcgctcgattcaggaagcatacaataaggaacacgggattaccccgcacacgattaagaaagatatccgttcgctaatctcagctaccacggagacggaagacgctggtgaaaaggacgactttttggatgtggacttcgcggatatggatcgtaaagaccaaaaagaaatgattgaaagtctggaagaccaaatgcgcgcggcagctaaagaacttgatttcgaaagggctgctaatctgcgtgatacggtattggaattaaaagcccagattgattaggaggaattccgtttggtaaatgataagattatcattcacggtgcgcgagcacataacttaaaaaatattgacgttaccattccgaaaaataaattagtggtggtaactggtttatctggttcagggaagagttcgcttgctttcgatacgctatacgcggaggggcagcgtcgttacgtggaaagtttatcagcatacgctcggcaatttttaggccagatggacaaacccgacgtagattcgattgacgggttgagcccggcaatttcaattgaccaaaaaactacttcgaagaacccccggtccacggtgggaaccgttacggaaattaacgattacctgcgcttactctgggcgcgggtgggaactcccgtctgtccaaacgacgggacgatcattactagccaaacggttgaacaaatggtggatcgggttatggaacttcctgaacgaactaaagtacaaattatctccccaatcgtgcgcgctaaaaaagggcaacataaaaaggtgtttgctagcatcaagcgggaaggttttgtgcgggttcgggttgatggtgaaaccatggatgttgaagaagttccggaattagaaaagagcaaggcccattccatcgacgttgtcattgaccgcattgtggttaaggaggggattcattcccgactctttgactcatttgaagcggctttacgattaagtaaagggtacgcgaccgccgatgtgattggcggagaccccattctattttcagaacactacgcttgcccaatttgtggatttacggtgggagagttggaaccgcggttgttttcatttaacgctccgtttggtgcctgcccagattgtgacgggctcggggttaaactggaagttgatatggacttagtagttcctgatcaggataaaacgttgcgggaaggggctttggctccttggaatccaattagctcccagtattatccaaaattactggaacaggcggcggaaagttttggcatcgatatggacacgccgttcaaggacctaccgaaggatgcacggcaactaattttatacggatccaagggaaagcaattccattttcattacgaaaatgactttggaggagttcgggatgttgataccgaatttgaaggggtcattaataatgtcaaccgccgttatcaagaaaccaacagtgacttcacgcgtgaccaaatgcggtcatacatgcgggagctaacttgtcaaacttgtcacggttatcgccttaatcggaaggcgcgggcggttaagattgctggtcaacacattggtgaggtttctgaattaccgatcgatcgttgtacgtccttttttgaaaaacttaatttttcggaacaagacaccgtcattgcaacgccaattttgaaggaaatccgggaccggttgaacttcttacggaacgtggggttggaatacctgaccttaagtcggtcggcacgaaccctctccggaggcgaagcgcaacggattcggttagctacccaaattggttcgaacttatccggagtactatatatcctggacgaaccttcgattgggttgcaccaacgggataacgatcgcttgattagttccttgaaaaagatgcgtgatctcggcaacaccttgattgtcgtagaacatgacgaggataccatgcgggcagcggactatttgattgatattggtccaggtgccggagaaaatggtggcgaagtaatggccgcagggactcccaaacaggttgaacgcagtcgtaaatcgcttaccggacaatatttagctggtaagaagtcgattccggtccctactgaacggcgggatggtaacggcttggcaattcaactaaagggcgttcaagaaaacaacttgaaaaacattgacgtgaagttcccattaggaaagtttattgccgttaccggagtttcgggatccggtaagtctaccctggtaaacatggtgttgaaacgagttttggcacaaaaacttaaccgaaattcggaaaagcctggtaagtataagtcggttagcggaatcaagaacattgaaaaggttattaacattgaccaaaccccaattggacggaccccccggagtaatccggcaacttacacgagtgtgtttgatgatattcgcggactgtttgcccaaactaacgaagctaagctacgtggatacacaaagggccgctttagctttaacgtaaagggcggtcgttgtgaagcatgtaagggtgacggaattctgaagattgaaatgaacttcctgccggacgtttacgttccttgtgaagtatgtcatggcacccgatacaattctgaaactttagaagttaagtataaggggaagaacatcgcggaagttttggatatgaccgttgaagaagctgctaagttctttgcgccaattcctaaaattgcccgcaagcttcaaaccatcattgacgttgggttaggatacgtgcatttagggcaatccgcaactaccctttctgggggcgaagcgcaacggatgaagttagctgctgaattgcataaaaaagctaacggaaaaaacttctatattttagacgaaccaactaccgggttgcatactgatgacattaagcggttgttagatgttttacaacgcctagtggataatggcaacactgttttggtaattgaacataatttagacgttattaaaacagcagatcacctaattgatttaggaccagaaggcggcgacggtggcggacaaatcgtggctaccggaacccccgaagaaattgcggaagtggccgaaagctatacgggtcaatatttgaaacctgttttagaacgagatcgcaagctacagaaaaagtaattttatcaaaaattaagcggaaattagaccattagattggttagatttccgcttttttagtagtaccgcggggatttttggcgatgacctttggtggtcgccaagttttcatggtatcatttaaaaaatgacacgcccggatgtgttatactggagaagttgttaccttggaatgggggaatcattatgaacgaatcattgaaattggtagtggtaacgggaatgagcggcgccggaaaaactgtcgcaatgcaaagtttcgaagacatgggcttcttttgcgttgataacatgccgttagcactgttaccaaaattttgggaattaattaaagaaaatggcaacatcaccaaagttgccttagcagttgatttacgttcggatgcattttacgaacaagtcatcacgatgctgaccgatacccaagcactttcgggaattaatcgtgacatcttgttcttggatgctactaatgaggaattaattgcgcgttacaaggaaactcggcgggcacatccgctagcgatggacggtcgggtagcggacggaattcgcaaagaacgcgaactgcttgccccaatcaagtcggaggcccagctggtgattgacactagtaatttaacgcctcgcgaattaagaagtaaaatttttaaccaattttcaaccaacaaaacggttcctaaattccatattgaagtagtttcgtttggctacaaatacgggttaccgattgacgcagacatcactatggacgtgcgttttttgcctaacccatactacgtgccggaactaaaaaatcaggtgggaaccgatcaaccggtgtacgattacgtaatgaaccagccggctacggaaaaattttaccaggcttatttaaagttactgatggatattatgccggggtaccaacaagagggaaagtcgaatttgacgatcgcgattggctgtaccggtgggcaacatcgttcagtagcgattgcggagcggttaggaaatgatttagctaagcactacgttactcacatttctcaccgagatgtaaataagcgaaaggaaacggtaaatcgctcatgagtaaaattaagggacctaaaatcgtggtaattgggggcgggactggccttccagttatcttaaatgagctacataaacgcaatgcagacgtgaccgccatcgttacggtggcagatgacggaggttcttcgggaattattcgagactacgttaacgtggttccgccgggggatattcggaacgtcatggtggctttgtcggacatgccgcccgaactcaaggacattttccaataccgctttaaaagtgaagataactttcttgccggacatgcgattggtaatttaattatcgccgcactttctgaaatgcggggcggaattgaccctgcaatccgagaattatcgcaaatgcttcaaattgaaggacatatttatccggcaagtgctgaaccactagtgttgcacgctaagtttacggatggcacgagcttagcaggtgaatcagaaattaccgcggcccacaaggatgttaaacaggtttgggtcgaaaacaatccttggagtgagcataaaaagccgcgggccgttccagaagccttagaagctattaaagcagctaacgaaattatcctagggccgggaagtttattcactagtattttgccaaacctaatgattgaagacattcgtaaggccgttttagcgacccaagcggaaattgtttacatttgcaacattatgactcaaaaaggcgaaacaatcggctttaccgatgccgaccacgtacgcgttttaaaccaacatctaggtcgaaactttgtggataccgtgttggttaataccgaaaaagttcctgaatcgtatatggatttcaaccgttatgacgaagtttccaaacaagtaattcataattttaaaggactccgcgagcaaggggtacgagtaatttcggataactttttgaaactgcgtgacggcggtgctttccatgatggtgaaaaagtggtcggtgagctaatgcacatctgtagcaacccaattaagaaacaagcataggaggtgtggtcgtgtcttatgccagtgaagtaaaaaaagagctgactagcttggaagtccacgaacataacgcaaaggctgaattgatggcgttgatccggatgaacggttcaattgggattaataatcggcagttagtgttaaatactcagacggaaaatccggcgattgcacggcggatttactcgctactaaaaaacttctaccacttagaagcagagttaagtgtgcgtcgtaagatgaagctgaagaaaaacaatctttacattgtgcgtttgcggacgggcgctcagcaactacttaacgatttatcaattttaaaagacgattttcaaattaacgaaaccgttccggaggggctcctatcaactgaatcggagctacgctcatatttaaggggggccttcttagcgggaggttcggttaataatcccgaaactagtcgctatcatttggaaatctattcgctttacgaagcccataatcaaatgattgcggattggatcaatcagtaccacctcaacgcccggacaacggagcgccgaagcggctacattgtttacctgaaggaagccgaacatatcgcagattttcttcaactaattggcgcaaccaattcaatgttaaaattcgaagatgttcgaattatgcgggatatgcgtaattcggttaatcggttggtaaattgcgaaaatgctaatatgaataaagttgccaacgcttcgatgaagcagattaataacatccagtacattgatgaagtggtaggactcgacgagttgccgcctaagctgcgcgacatcgcgaagacacggttagcgcaccgggaagttagtttgaaagagcttggcgaactagtgccgggtgggccaatttctaaatcgggggttaaccaccggttaagaaagattaatcagtatgcagaaaagttgcgagcttaaagtttttcgcaataaaaaatatttcgtaagaacttttgcattggttaatacaggaccaatgaatataaatttatctaaaatacgtggggatggacaggaatactgttaacttcgcgtatttttattttgcaagtaaaatgtgccaaaagcgctacactacggactttgtaactataatgtaaaacgttttaataaacagatgtgctatccttaaggggatatataaatcaacgccgaaaaggtttggatataggagagtagttaatatatggaaatcaaaaagcattacaaaatgtttaagtcagggaagaagtgggcattcgcaagtatcgctacagctagtttgggtttggtagcactcaatactaatgctgaaaaagcacatgcggatagcgatgcgcaagctaacactaattctgcaagtcaacttgatcaacagaccaagatggctccggttaacgaaaagcaagttacgttatctaagccagcgactgtcaaagctagttcagctgccgttacagcacaatcagcagccccagcttctagtgctgctcaatctgcagctaaggttaacgcggatagtactgcaaaggctgaccaacattctgctgcagcaaaagttgaaaccaaagcaactacttcttcagcagtaaaaccagctaaggaagccgcttcagctaatgcagttaaagcagccccagcttctagtgcagctaaaaaggtaagtactagtgtagctagttctgcagctccaagctcggcagcaagcaagacggttacttcagcagccgttaaggatagcgcagctaaggaagccgtatcttcagcagctaatgtgaaatcaagttctgccgcagctaaaacttcggttaattcaagtgcggtttctgaagctgcccaaaaagacgctaaagcggaaaaaactgcagaaaagaagaccgataactcatcgaaggactacacgattgataatacatatcggttagctgataacgaaggtagcgatcaaaagactaacaataaaattatcgttgcccatgccgttggacaatactcatctgctcgcgacgttgctatctacgaaaaacgggaatgggatagtagtgaaacctacgttcaatacatcgttggagatggcggacgggtatacgccgttggagaagaagggtacgttgcttggggtgctggtaaatgggctaatgaaaatgctcccgttcaagttgaattagcacaaacttactcggatagccaattcaagaaggattaccaaacttacgttaacttactccgtgattccgcaaagaagtggaatattccaacaactttggatagtgatgaatacactggaattaagtcacatatttgggttaccgaacatgtttggggaaatcatgttgacccatacggttacttaggtactcatggaattaccaaggaacagtttgcgcatgatttggcatatggtttcggtaatgatgctgctaacgacaaccaaaacaataatcaaaatgataatcaccaaaatgataatcaaaacaaccaaaataataaccaccaaaatgactcttcaaataaccagggcaaccaaaataaccaaagctaccatgtaggcgacaaggttaccatcaagaacagtgcttctcactgggcaactggtcaatccatttacaatggggttaagggtcatacttacaagattatccaaactaatggtcacaagttgttgttagatcaagtaattagctggattaacgacggtgatgtttacaaggcgggttctaattccggttcgtcaaacaatcataataataatcacactactaacaatgcggacattaaggttggtaccgtggttaccattaacaacaatgctagccactgggcaactggtcaaagcatctacagtggtgtaaagggcaagagctacaaggttatccaaactaacggaaatcgtcttttattggataaggtaattagctggattaacaagggcgacgttcacgttcccggttcgaactcgaataacaataactctggcaaccaaaaccataataacggcaataaccacaataataacggtaatacagaatcaatccacgttggctcaaaagttaccatcaataacaatgctaagcgttgggcaactggtcaaaatatttatagcggtgtaaagggtaagacttacacggttattcaaatgaacggtagccggctattgttggataaggtaatcagctggatcaacaagggtgatgttcaccttcctggttcaaacggttcgcaaaataacaataacaacaataataaccacgctaataataacgatggtacgatccgggttggtacaaacgtaaccatcaagccgtctgctaaacgttgggcaaccggccaaaacatctactacggcgtaaagggtaagacttacaaagttatccaaatgaacggtaaccgcctcttgttagataaggttattagttggattaataagggggacgtatacgttccaggttcatccaataataacaatagcaacagcaataataaccacaacaacggtagcaattaccactttaccaaccaaaactggacggctgctcaaactaactttgttaacagcattgcagcagacgtaatgaacgtttgccaaaacaatcatttatacgcttccgttgcaatggcacaagccgttgtagaaagtgcttatggtgcttcaactttggctcaagaagcacacaacctctttggaattaaggcagacagcacgtggcatggtgcaacctataccaagaatactcaagaagttattaatggtcgggtagtaactatttcagctgcgttcagaaaatacgattcattcaaggattcgattgcggactacgctaagaaattagaatcacgtccacaatacgcaaatgcattttctaaccatacgcacaactacgttgaatcagttaaagtaatcaaagctggcggttacgcaacggcacctacttacgtaagcagcattgttaattgcattaataactatggattctacaaattagatggcttggactcagcaatttcgttgtaatttctgtagataaaatttaatataggtgtataagcagaagaggctggaacgtaatgttacagtctcttctttaataagtgagtgatgggggatgagcaaaagtgaagtataaagaatatcaatttgttcagctatgggacggccgaatgggtacaattattaagacgctgtccagtggcggctatttaattgaagataatttctggggttggctagaaatgaagagtaaggaagatcccgaacattacattttcccaaataccgatgtagaacggcgcttctctgctttggaagaagaaattgaaggggaagcccgaatggccgaagaatggtatgaatttcggtacaaagtgatggttagcggtttagggaattaaactatagataaaaaagagcttggaaatcgttttttgatttccaagctcttttgctttgcaagtatcagtaagattgcttacttaaggcttgcgttcttttccatgataccgtcgatcaaaccataatcaactgcgtcttgcgcagagaggtagttatcccgttccgtatcaaggttgattttttctagcggttgaccagaattttctgccaaaattttatttaactctttccgagtcttcaaaatttgttcagcggcaatttcaatttcagtttgttgaccttgagcaccaccagaaggttgatgaatcataacttctgaatgaggcaatgcaaaacgtttgccctttgtaccagaagaagctaaaacactggccatcgaagcagccattcccattacgatggtttgtacgtcagctttaatgaagttcatcgtgtcgtagattgccaatccagcagtaactacgccacctggagagttgatgtaaaggtaaatgtctttttcagagtcttgtgcatcaaggaatagtaattgagaaatgattgagttagccaaatcatcgtcaattggacctgataacataataatccgatcttttaatagtcgtgagtaaatatcataagcacgttcgccacgtgatgattgttcaataacggttggaaccaagttcataacttagtagcctccttttcggataaagatttagtattaattactaaccatggctttagtttatctcattggtcaaaaaaggtcaaatgtttttgctcattcattaaaattaatgcttcaaaagtactatctagcaccaacaaggagtaaaggatgggggaagaaatgaaaatacttgttaaaacctacgctggaatactaaatacgggtttatcatggataaagcgctattactagtatataatcgacgttaaagaaggacttatcaaaatggtaagttgtttataaaaaaatatctgtcatcagcaattattcaaattactaataacagatatcgggaactgaagatgacaattactcgcaatctcagtacttttacgtttcagaatataaaaaaatgcgccatcggggagtcgaaccccgatcttgagaaccggaatctcacgtgctatccattacactaacggcgcttaacaaaataaattttacattatgttggcaaaaaaaacaagctaaaaataatagaattatggagaaaaattttatggtaatgaagcaaggatttacgcagaaccaaacgcaacagcaaaagcaagtgcagcgtttggcaatgacgcaaacactacagcagtcaattcaaatgctgcaatacaatgctgaagagttgcaaaatttcttgaaacaaaaggaaatggacaaccccttaattaccgttgaagtagctgaagaacggcctttaagcaaggtgtcgaaaaattccgacacgcatgagacctttatgaatcaaattgctagcgatacggaacaatcattatttgattatttattggatcaagtccatctaactatgcgggatacgccactaaggaagttggttcttttcctattggattacgttgaccaaaatggttatttgcgaatcacggaagacgaaattaagcaaaaaacgcaggctgatgacattgccatcatggatgcagtcacgcttttgcagcaactggatccgcccggggtcggagcccgaactctgcaagaatcattaatgctccaaactgaaaatgacgagggttcgcctgagattgcttatatggtcttagaagagtcgtttgacgacttagttgaccgtaattgggaaaagattgctcagcgatatgacattacattggctgaggttcaagaagttttcgactacgtgcgcaatttaaccccaaatccaggagcgggctttggtaagcaagatcgcggatacattacgccagacttaattttcaagttggaaaatggcgaaccccgactaatccaatcgaaagcttcgcgaccacgggtcagtttttcacaggaatactttgaacaattacgtaaaaaggctgacgatgaagtaagcagctacgtaaatgagaaaaaacgcgaatacgattggattgccaaaagcttgacgcaacgccaagataccattttaagggtgggcaagataatttttgagcgacaacaagactttttccttcagaagagtaaagaattaagtccgttgatgctacgagacgtggccaacaaattacatttacacgaatcgacggtttctcgtgcggttaatggcaagtatattgcaacgccctttggaaccttcgaattacgttctttcttcagcaatgcggttaaccagactagcgacgtctccgccgatgcggccaagcaaaagattaaggcaattattgatcaagaagataaggaaaagcccatttcagacgctaaaattgaaaagcagttaaaggcgcagggggtcacgatctcccgcagaacggtcgctaagtatcgggaagcgttgggaatcccgtcgtcatcaaaacgaaaacgctatctggaaaaataagcttaaaattaaatagaatatttaggcaggcaaatttgcaaaatgatggggagcttgttataatttgatttgtaagtgaggtatgcaacaagaattagttcttatggttgtgtgccatttatttttaagttgttgggtcgttttatgacacagctggacaaataaagtcccatataggagataacatggatgataatgaaatggatttattagagtctgttgtcccgggtttaatcagcgagtttctacaaagatttgatattttaaaatcaatcgacttgttggctccagttggtagacgagttttatccgaacacttacatctaagcgagcgggttttacggtcccagacggacgtgttaaagtctcaagggttgctaaagacctcgccagcggggatgtcgctatcggatgagggtcgtcgggttatgaacggattggaaccggtggctaatagattcttgggcttaactagccaagaaaagcaattagcggaacggttaaatatcgaacggtgcttcattgttcgcggtgatcaagcggagagcccggtcgtttccaagcaactaggaattgtcttaaatgacgcacttgcaaaattattgccggagggtactaatactatagtggtgatgggcggatcgacgatggcgtcggtagcgacgaggcttaaaccagagctctcacagcaccgccagttgatttttgttcctggaaggggcggcattggcgaatcagtttctaagcaagctaattcagttgccgctacgatggccaagcagaccgcaggggaagctaagtcattatatattccggaacaactcagcgaaagcacatatcacccgctactaaatgaaccaacggtgagaccggtgttggacctaatcgtgcatgccggggttgccatccacgggattggccgagcagatgcgatggctcaaagacgaggagttaactccgaaatcaagagttatttgcggaaggcgcgggccgtgggagaagcgttcggctctttctataataaggaaggtcggatcttatatcaggttcatcgcattggactccaattacaggatgtccagcatttcaatcatgtatttgccgtggccggtggtcatgacaaggctcaagcgattgagtcgtacatgaaaattgcaccgcatcagacaattttaattactgatgaaggtgccgcaaacgtgattttaaaaaagtgaggccaattgtgactgaactttttaaaataaattatttttttagattcctaaaggaggaaatcttagtatgactgtaaagattggtattaatggttttggacgtatcggtcgtttggcattccgtcgtatccacgaattgggtgcaaagtcaaatgatatcgaagtagttgctatcaacgatttgacaagtcctgcattattagcacacttgctcaaatatgattcaacacatggtactttccctggcgaagttagcgcaacagatgacgctatcgttgttgatggtaagaagtaccacgtttacgcagaacctcaagctcaaaacattccttgggttaaggaagacggcgtagacttcgtacttgaatgtacaggtttctacacatcaaaagaaaagtcacaagctcacttagacgctggtgcaaaacgtgtattgatctcagctcctgctggttcagaccttaagacagttgtttacaacgtaaacgatgatgttttaactgctgacgaccgcatcgtttcagctggttcatgtacaacaaactgcttggcaccaatggcatacttcttgaacaaagaatttggtcttgaagttggtacaatgacaacaatccatgcttacacaagtacacaaatgatccttgacggccctgttcgtggtggaaacttccgttctgcacgtgctgctgcagctaacacaattcctcactcaactggtgctgctaaggctatcggccttgttatcccagaattgaacggtaaattacaaggacatgcacaacgtgttcctgttgttgacggttcattaacagaacttgtttcaattcttgacaaggatgttacagctgaagaagttaatgctgcaatcaagaagcatacagaaggcaacgaatcatttggttggaacgaagacgaagtagtatcaagcgacatcattggtacaacttacggttcaatcttcgacccaacacaaacagaagttacaaaggctggcgacaagcaattagttaagactgttgcttggtacgacaacgaatacggcttcacttgccaaatggtacgtactttattgaaatttgctactctttaagattaaattcttaaatatttgtagatttcaaaccgtctaatcggtcttggagacggagggaggtcacttcctccgtctctttttttaagaaaaaataatttattgctcacttaaaaggaggaattatcttggctaaattaacagtttcagatttagatgttaaaggcaagaaagttttgatgcgcgttgatttcaacgtgccagttaaaaatggtgtgatcggtgacgataaccgtatcgtagccgcactaccaaccatcaaatacatcattgaaaatggtggaaaggcaatcctcttctctcacttaggtcggatcaagaaggaagaagacaagaaagaattgactcttcgtccagttgctcaacgtctttcagacttgcttggcaagccagttacttttgttcccgtaactcgcggtgcacaattagaagacgcagttaacggcttgaacgacggtgacgtattgttattcgaaaacacacgtttcgaagaccttgacggcaagaaggaaagtggcaacgatcctgaattaggtaagtactgggcatcacttggcgacatgttcgttaacgatgcatttggtacagcacaccgttcacacgcatcaaacgttggggttgctacagcaatgaaggcagaaggcaagaaagttgctgctggtttcttaatggaaaaggaaatcaagttcttaggtgaagctgttgacgatcctaagcacccattcgttgcaatcttaggtggtgctaaggtttctgacaagattggtgttatcgaccacttacttgacaaagctgacaaagttatcatcggcggtggtatgacatacacattctacgctgcaaaaggcatgagcattggtaactctcttgttgaagctgacaagattgacgttgctaaagaaatccttgctaagggtggcgacaagatcgttcttcctgtagacagtgttgttgctgaaaaatttgacaacgatgttcctcacaaagttgttgaaggtgacattcctgacggttacatggctcttgatattggacctaagtcagttgctgaattcaaggacgttcttaaagacgctaagaccgttgtatggaacggaccaatgggtgtattcgaaatgagcaactacgctaagggtactcttgaagttggtaagttcttaggaactctatcagacgcaacaaccatcgttggtggtggtgactcaactgccgctgttaagcaattaggcgttggcgaccaattgacacacatctcaactggtggtggcgcatcacttgaataccttgaaggtaaagaacttccaggtatcgctgcaatttctaacaaataattaacttgaatggggtcgggaatccacagggattgctaatcccgttcggttacatattttgtgattaagaaaggatgttttattttgcgtactccaattattgctggaaactggaaaatgaataagaacccccaagaaacacaagaattcttggaaggtatcaagggcaaattaccagatgcttcagttgtagaatcagtaatcgctgctcctgcaattgatttaaacactttagtacaattctctaaagatgaacaactaaagactgctgctgaaaactgctacttcgaagatgaaggtgcttttactggtgaaactagtccaaaagcattgtctgaaatgggcgttaactacgtagttatcggtcactcagaacgtcgtcaatacttcaaagaaactgacgaagacatcaacaagaaggctaaggcaatcttcaagaacaacatgaagccaatcatctgctgtggtgaaacgcttgaacaacgcgaagctggcgaaactaacgaatgggttgctggccaagttactaacgctcttaaagacttgtctgctgaacaagttgctaacaccgtaattgcttacgaaccaatctgggcaatcggtactggtaagactgcttcaagtgaccaagcacaagaagtttgccacgtaatccgtgaaacggttgctaagttatacgaccaaaccgttgctgacaaagttcgtatccaatatggtggtagtgttaagcctgcaaacatcgctgaattgatgagcaaagaagacatcgatggtggccttgttggtggtgcttcactcgatccagaatcattcctacaattagttaactaccagggttaatttaattctagaaatataatataatggtaactgcataagcagattataaaatgtgaggagatattaaaatgtcacttattactgatatttatgcacgcgaagtcttagactcacgtggtaacccaactgttgaagttgaagtttacacagaagacggcggctttggtcgcggaatcgttccttcaggtgcttcaactggtgaacacgaagctgttgaacttcgtgacggcgacaagaaccgttacgaaggcaagggtgttgaaaaggctgttgctaacgttaacggcccaattgctaaggaaattgttggttttgaagtaactgaccaaatcgcaattgacaaggcaatgatcaagttagacggtactcctaacaaaggtaagttaggtgctaacgctatcttaggtgtttctttagcggttgctcgtgctgctgctgacgaactccaaattccactttacaactacattggcggatcaaacgcacacgttcttcctacaccaatgatgaacgttatcaacggtggtgctcactcagataacaaagtggacttccaagaattcatgattatgcctgttggtgctccttctgttaaggaagctatccggatgggttcagaaacattccacgcattgaagagtcttttagctgctgacggcaaagctacttcagttggtgacgaaggtggtttcgctcctgactttgctaacaacgaagaacctcttcaatacttgatcaaagcgatcgaaaaagctggttacaagccaggtaaagacgtagcaatcgctgttgacgttgctgcttcagaactttggaacgacgatgacaagaagtacaagcttcgctggtcaactggtgaagaattcactactgaagaattcgttaagtaccttgaaggcttagtaaacaaatacccaatcatttcaatcgaagacccaattgacgaaaacaactgggaagactgggcaagcatcacaaaagaacttggcaagaaagttcaacttgttggtgacgacttcttcgttacaaacactgaataccttgcaaaaggtatcaagatgggtgctgctaactcaatccttatcaaggttaaccaaatcggtacacttacagaaacaatggaagctatcgaaatggctaaggaagctggttacacagctatcgtatctcaccgttcaggtgaaacagaagatacaacaatcgctgacttggttgttgctacaaacgctggccaaattaagactggttcaatgagtcgtacagaccgcattgctaagtacaaccaattaatgcggattgaagaccaactcgaaggcgttgcagaatacaagggtatccactcattctacaaccttagtgcacaagcacgcgaagatattacaaacaagtaattcatttcgagtgatctaagagaaggatggacattttgtccatcctttttttattgtttaaattggaattcacccgtaagtatgttaaattaatactagaacttatttagaatacaaaggaggtcatcttgtgtactcacttttgatgacaattctattgattctgtcagtggtcataatcattgcggttatgatgcaaccggcaaagactgataatgcgatgtcttcattgacaggtggggctggtgacctattttcaaagcaaaagtcacgtggatttgaagcgttcatgcaaagagtaacggcagtcttgcttttcttgttttttgctatcaccattgcaatggtttacgtatcggcccattaaaagcgatcgtatctaacaaaaaaattgcatttagcgaagtcctaaggcatttttgggacggattaggaatggctaaagacaaaatcgagcatggttttgtctttagcttttttatttaatactatgaatttatagaggtaagtaatggaatcaagtaaacttcaagcttcaatcattaattatttggagcgacggcctacacaaaaattcaccgcggaagaattgtttaaaggtcttagtttagaaaaggcgtccgtattcaacgaattggtcaaagaattaacttcgttggaacggtcccataaagtagaaatcacggcggatgacaagtttaaaattgcccgcccccaaaaccagttgctcgttcacggaacctttcgggcaaatgaccgcggctttggttttgtagcggtagaagatgatgaaattcctgatatttatatcagtgaagaacacaccgcctacgcgcttaatttggacgaagtcgatgtaaaaatcgtgcgtccgtctaaaaaaggtgacgaccggggtcctgaaggaattgttaagaaaattaccaaacggcatctcacccaagcagtgggggtatttgaatttgctccagaccctgctcataacgtgctcgggcacattaatctaaaagataaaaagatgtctaactacgagtttgacgtgctagaaggcggtattcaccccgaagacggagcggtgattactgctcaggttacccagtatccaaaacccaacgctcctaagttaattgcaggggttgcggaaaaaacgattggataccgcgacgatccgggagtagacattctggaaattgtttaccaacatgagttaccaactgaatttccggatgacgttaaagaagaaattgctcaaattccagaccacattactgaagccgaaaaacaaggtcgcgtggacttaactaacgaagtagtggttaccattgacggcgatgattcaaaagactttgacgatgcggttggcttacaaaagttagacaacggtaactaccgcttgctagttaacatcgcggacgtttcccactacgttaaggaaggctccccgcttgataaggaagcataccggcgcagtaccagtgtttatttgacggaccgggtaattccaatgttaccgcgaaagctttctaacgggatttgttccttaaaccctaacgtggaacggctagcgatgacttgtgaaatggaaatcagtccggatggcgaagtgttaagccataaaatctacccaagtgtcattgagtctaacgcccggatgacttataacgacgttaacaaaatcttggaagcacgcgataagaaaaccatcgagcgttaccaagatttagtgccaatgtttgaaatgatgggcaagttgcacaaattgctgttgaagcgccgtaaacaacgcggagccattgaatttgacgacaacgaagcacaaatcattgtcgacgaaaatgggcacccaattgatattaaggtgcgggaacgcggaacttcagaacggatgatcgaatccttcatgttggcggctaatgaaacggtggcagagcattactacgacgcccacgtgccattcttgtaccgggtccatgaaaccccagatagcgaacggatgttaactttcttcgaattcttatcaacctttggccacgtggttaaggggagcactaaggatcttaaaccaaagatgttgcaaagcgtcctcaaaaaagttgcgggaacccgtgaagaagccatgatttcggttatgttattgcggagcatgcgccaagcgaagtacgatgctaggtcattaggtcactttgggttagcagctaagtactatacccactttacttcgccaattcggcggtatcccgacttgtttgtgcaccggttgattcgccattatgcggaagatggtactggaaaagacgctcaagaaaagtacgcgggcattattccggaaattgcggaacatacttcccaacttgaacgacgggcaatcgatacggaacgcgatgttgacagtatgaagaaggctgaatacatgggcgaccacattggtgaacaatttaacgccatggttagttctgtaatgaagttcggactttttgttgaattggaaaacaccattgaaggcttaatccatattagtaccatgaaggatgattactacgaatacgtggaaaatcaaatggcgctagtgggccgtaacacccaccgaaccttccaaattggtttaccagttgcggtgaagttaatgcgggtagaaaaggaccaggctgaagtggactttgagttgttgcatccggaaaagacgccaactagtgaaattaagttgccacctcgccaatcctttaaccgtaacaagggcggtcaacggaatggtaaccgaaatcgccgacaaaatgggcaacgttctaataattccaacaacaaaccattctacaaagataaaaacgtcaaacgcttttctaagaatacttctcacaaaaaataaagaggagggtttcgtatggctaaaaaaccacaggtaaaggatcaagctttagcccaaaataaaaaggctcgccatgattattctattttaagcacgatggaagcgggaattgccttaaccggcacggaaattaaatcagttcgggaacgccggattaccctcagagacgggtttgtgcaaattcgccatggtgaagcaattttgatgaacgtgcaaattagtgaatacttgcaaggtaatcagtttaatcacgatccgttgcgaaatcggaagcttttgttgcacaaaaaagaaattcaaaagttacaagaagctagccaaaataaaggaatcacgattgtgcctttaaaagtttaccttaagcacggctttgcgaaggtactgatcggggttgctaaaggaaagcacgaatacgataaacgagaaactttgaagaaacgtgaccaacaacgggaaattgaacgcgcgttgaagaaccgttaaacggatcacgcttgttgataagtgaatagaattgtaatgtaacttagtgttggaatggcggtataacggcattttggcagtttgaaaattaggtcaactcacttaaatctacatgtttgtttgccaaaatgtttgccatatgaagaaagcatccagtatccaaaactgggtgcctttttttgcttaactattagttgctgatgatgttaggttgaggagtaattctaaatattagataatgatttagtgagatacgaataaagtaatcgaggagatacgatggccaaatttaatgaactaataacacaaattaataataacttggacaaccaacgggatagaggcactgcatttgaaaaaatggtactggcctatttaaagaatgagcctacgtaccataacaaattcagtaatgtttggatgctgaaagatattccagataagtatggcattcctaaaaaagatactggtgtggatttagtagcggaggaccgtattactggtgaacttaccgcaattcaggctaaattctatcgtggtaaggtcggtaaagatacgattaactcgtttattgccgaatttagtaaaaactattatgctgcaggaattatcgttagtacaacggaccagtggaatcgcaacgccgagcaatctctagaaggattatccaagccaatgacacggattggcttagcacagttggaacacgctaatatcgactgggaactattttcttttgatcagaataacgatcacctacgtaagagagctaaaaagcttcgcgattaccaacaagaagctattgataagtctttgagttattttaaagatcatgatcgtggaaaattaatcatggctccaggaacaggtaagacttttactagtctaaagattgcagaagcgctgatgaaagatcagaaaaagggaaactttaatgttttgtatttggttcccagtattcagttgctgtcacaaactctttttaactggaatgatgatcacgctgaaagtatttatatgaattcgttctcggttgtttcagatagaaaagctacgaagcagaaacatggtaaagacgatttaagtgcaaaagatattggctttccggcaaccactaatgttgatgatttgctaagtaattttcagaagattaagcagaatgaaaattaccaaatgaatatcattttcagcacttaccaatcgattgatgtcgttcataaggctcaaaattcaggcttgccggagtttgatcttattgttgctgatgaagcgcaccggacgactggggcaaacgaaatgggagaccctagcgtttttacaaaagttcactcaaacaaaaatgttaaaagtaagttgcgcctttaccaaaccgcaacaccaaaggtttatggcgttgaggcgaaaaagaaggcgcacgaacaaagcgttgtaatatcttccatggatgatgaaaaactttatggccaagtgatttttcatttaggctttggtgatgctgttaacatgggttaccttactgattataaggtgtccgttttggcggtcagtgagcaatatgttaataagacccttcaagcaactttgtcctcggataatgagttgaaaacggatgatcctgggaaaattattggggtttggaacgcaatggttaagcgtaatggcttgaatggtgaaattaaaggagcaccaatgaagcgagcaattgcttttactgataccattgcccattccaaagaaattgccaaggaatttaacaatgttgttaatgattatttgggcaaagaagccgatgaaagttttagtgttgatgtgaaacacgttgatggctccttaaatgctctagagaagaagaatgctttggactggttggctaatgatatgccagaaaaccatgcccgtgttttatctaacgttcgcttccttactgaaggaattgatgttccgagtttggatgcggtgatcttctttagtccgaagaagtcccaggttgacattgtacaagcggttggccgtattatgcggcgttatgagggcaaagattatggctatattattcttccagtggttattgatgcgggttccaagcctgaagatgttctggataacaacaagcgctaccgggaagtttggcaggtactaaacgcgcttcgctcaactgatgaacggtttgaagcagagattaacaagcttcaactaaataagaaaaagtctggcaagatcaacttcattggtacagatactagtccaagtaaaccagtcacggaggctggtggtcaagaagctgctgaaaataaagtaaatgagactgctaacaattatcaaactgctttagcgttaaagtggggagaaatcgaacaggctttctatggtcgtgttgttcaaaaggttggtgatcgccgatatcttgaagattggtcagcggatgttgcaaaaattgcccacaagcatattcaacgaattaacgacttgattgacacaaacactcaggcttctaaggcatttaaccagtttttggagagtttgcattacaatatcaacgattctatagattgcgatcaagcaatcgaaatgctagcccagcacttaataacccagccagtgtttgaagcactatttgctggttatagttttattaaggataatcctgtttcacaagcgcttaatcgggttgtttctgtttttgaaaagtatggctttgacaacggtcagcaatccctaaagcccttctatgattcagttaaagcacgcgcccaaggaatcgataatgcagcagctaaacaaaagattatcgttactttatacgagaacttctttaagaaaggctttgaaaagacgactgatgcaatggggattgtctttacgccagtagaagtagttgattttattatccattcagttgatgacgccttgcaaaaatacttcggcaagcaattagctgataaggatgttcatattttggacccctttactggaacgggcaccttcattactcgtacgctgcagtactttaagcaacaaatggaggagggtaaaattacctaccaagatgttctccacaaatatatgcatgaattgcatgctaatgaaatcgttttgttaagttattacattgcggctattaatattgaagcggtatttgatgaagttaatgggcctgatagaggatacaaaccatttgacgggattgttttaactgatacgtttgaaagtactgaacggcagaattcgttcatggacgaactgttaggacaaaacaacgaacggctgaagaaacagcaagaacagcctattaccgctattattagtaatccgccgtattcagtgggccaaagtaatgctaatgataataatcagaatatgcattacccatgcctggaaaaaaggatgcaacaaacttatgctactaaagcaacattgactcgtggaacgtatgattcttatgttaaagcttttaggtgggcttccgatcgtattaaggacaaaggtgttattggttttgtcactaatgcaagttatattgacagtaaaagcactgatggactaagaaaatccttatatagtgaatttaattatctttatatttttaacttacgaggtaatcagcgaactaaaggtgagcaggcaagaaaagaaggaggaaagatttttggatctggcagccgtgctccaattgctattagcattcttattaaagatggctctaataatcataaactttactattatgatattggtgattatctttcacgtagtaaaaagcttaatatcattgaagattttaattcagttaaaggaattgaatggcaatctattagccctgatcaaaattatgactggattaatcaacgtgatccacattatcaagcatatagtgctatatcgggagaagagttatctcctttctatgataatgcacccggtataaataccagtagagatgcttgggcaatttctttttcaaatcaaaaagtggggcaaaatataaaaaaacttattttgaattataataatggcctagataaacacatagatgattcgttgataaatgatgttaattggtctgcaggcttgaggaaattatataagaaaggagttatattagaatataatcctaaaaaaatactccttagtatgtatagaccatttactaagaagtggttgtattatgacaggtatttaacagagcggccaggtaaatatgcacatcaatggggcaaacataatgaagctattttaacttcaggacggggtgcaaacgtttttgctacattagcgactgatttaattcctaattttaactgtttaaccgcaactcagggattcatgaaattaaacaatgaaagtagtaaaacattgtttgcaaaaagcaataatgttaatgagaattttgcccataagctaggcttatctttaaatcaaacgtttgcttatgtttatgctgttcttaattctaaagagtataaaaagcgatacacaaatgatttgaaaaaggagctagcacggattcctttactaaaggatacagttcagtatgcgacaattggtcaaaaattgattgatttgcatctgaattatgaatctgtaaaaccttatcaagatgtaaatgtagtctttaagggtgaaccgtcgtacagagttcataagatgaagtttgctaaaaagcgcaatcctgatacaggaaagttagaaaatgatcgttctacgattatcttcaatgactctataacaatatccaatattccagataaggcatatcaatatgttgttaatgggcggtcagctattgaatggatcatggatcaatatcgaattaagactgacaataaatcaggtattactgacgacccaaatgattatagtgatgaccctaaatatatatttaatctactgttgagaattattaacgtttcagtccaaaccgttgatttgataaaccagttacctaaattaaatattgtggagtagataactttgttatgaagtaagaagccatcgacatgaatccatgctgatggcttttatcattactaaataataagggctatctgtcaaacatcctaaagtaagagtaatcaaatgtattttttgattactcttttttatataatctaattgagatttaggtcgcccacactagtaagatgtaaatcttgattgtcaaactggccagataatacatggtgcttagttaggttaaggatgttggtcttaaagatcgtggttagaaaatgaacgtgctcgtgtaattatcatctcaatattaattggaaggtgatgttgtgaacgttattggtattgatgttgctagaggtaagagtaaatgtgcgttaattattggtgatcttgttgataaatactttgagattaaacataaccgaagtggtttttctaggctttataacatcgcaagggaaacaaaatctttaattgtatttgaaactactggagtttattcttcacaattaactcagttttgtattcaggaggatttagattttttagagcttaatccactagaggcttcaattagaatggctggacttagaagagataaaactgaccgatctgattcagaaaaattagcttttcttgctataaatcaacataacttacttgttggccgacggccatgggattcttcatatgaagaattgcgtatgctaggaagccgctattttcaggtaacaaaagaaagtgctcgttctataaatcatttgcatgcggctttagagagagtatttccagaattaaatgacgtttttgatttaataaaatcaactttggatttgagaatgattgagctatttacacatccggattttgtgatgggccagaaaatagatgatatggtagaaaaagtttggagttcagtaaatcataaaattcatcatgacttggtagtacaaaaatgtgaagaagtttggcatgcaagccgatcttcctatccggcggttgaatcggactctattttagtcgaaataacccaatcatattgtaatgaaatcagaaatttcaatgctgaaaaaaatagtattaagaaaaaaatgattaatttagccaggaaagaacctgaacttaaaattataaatagtattccaggtgcaggcgaattatctgtggcccttttaattggatatgttggagatattcgtagatttctaacttataagcaaatgaatgccttcgttggaattgatttacacagaattcaatctggaggattgaagaacgatcatattaaccgtcgtgggcaaaaaaatgcgcgctatataatgtttgatatggtcagatcaatgttaagaaatcaagctacaatagacaatcatatagtggattattactataaactaaaaaaagggccacatcctaaatcggatatggttgccatgattgcctgtataaataggctaaatagaactatcgtaaatctggtccgcacaaatcaaatttacgattattttaaaaccgcacattaaaacataaaaatatttaagtaatttgatgttgtaaagaatggtattcctttacttgtttttagtgtactctattttagcaataaaataaaatttgacattctattagaaattagtctgggcgatagtagagcggtgacatgctttgcatagaaagcgttgtttatctatttgaagaatgaccggcttaccattaaagggaatatcacggatatacacagttttaaacccgttttttacaatgcttcttgtatgacaataggcacaggaggttaaccgataggttaatttaccgattacacgataaacctccttttcttccataacagcctttatttctagattagggtcacttttagttaaattatcttgtataatatctttatgggacatattatcatctgctttcaattgggttttcgtcgacatgattgtagcattaaggatgatgatatgtccttttttgcatgaaaaaagtgtcgacaaacagtttgttactgttcatccacacttgttattatagagccaaaatagctgtggataactccctccatcgaggggaataatccatagctatttttggtttctacagttacttagcaaggtgatgaaaaagaggctggataagagtcgggtagtttatgagtaaactaaaaatcgactattatgccaaattcaggcataacagtcgattttaggttgagtgatgcaagctgcttttgctgctatgaaaggcaacacaccaaaacgatttttaactttaacaagggagttttagtctttcccctatccttggtttcgattactttaatgagaattcgagaaggttaaacttcctttttcaagtgttggtagtggtgaccagaaacaatttgccggtggtcgagttggaaaccaattcgccggtaaaggcgttctgcgtcaggattcaaatcgtcaaccagtagcccgaccatttttaagtcacgagctttcgcgtattcgggaagggcattgagtaacttagtaccgattccgtgattttggaaatcagggttaactactagcgaatcgaggtaccattcgtcatcgtcagcttcagcttcttcgtaaatgggctgaggagcgagggcaacttggtcaaaatgattttgaaattcatcctttaacttctcttcgttagcacctggatagccaaaagcgactcccgcaacttggttatccattttagcaacaaccacgtcggcagcctcttggtatagggggctttggaaggttgctacgaatagtttagtaacttcttgaggatcgtttttcaagtaaaaaggcagttccatttcgtcgagaatgattttgagtagctcgacaacctggggcatgtcttcagtagtggctttagtgatttgcattagaattctccttcgaaaaattattatagccagccgtgtctgactcaatcttccaagttcgaactagtttaggctcccgaagcggggggcgtttttgaatccagcggtcgagaatcgccgctaaacaaataaacagtggcgtattggattctacgaaaacgttcaattcaatatacgcactgccgttgatttgaacgcggttaacttcaagaattttagttaaaccatgaaaaaccttaaaatggcaggtaacggtatctccaataataatccagcgaaggttgtgaacgtacaagagcccgcgaatgaagcctacgggagtcgtcaccatcccaacttcgtggttatttaaaaacaatttaaacttgggtaatagtcctaccgcgatttgcttaagctcagctcggagctggccttgcatatcgtaaacagaaagggcatcgcgtttgatgccccatttgccaactagaaggtatttggaattatggttttcatcgctaaccgtggtagcacctttattttctagcccttgactttttagatagaatctctgcatcggcttagcctctttttaattattgttgattttcggcaagctgttccaggatggcttttccaaccccatcctcgttgttagttacggtgaggtggtttgccaagcgcttgatctccggaattgcattacccatggcatagctaacgcccgcgacgcgcaacatggaagcgtcgtttaagttatcaccaatcgtcatcacttgggacatcggaattccaagttggtccgcaaaattctgtacggcaagtcccttttgcgcacggggactgttgatttcaatgttattttcaaacgatgatgaaattgctacgtcaacttgttgttgaatagcttcccggacgggttgtaatcccttttgaccgttttgaccaaacgcaaccagcttcaaaatttgaattttcggatcgtcaagtagcacttggtaattatctacgtaccggatgttcattaattctactcgggcagaagacatggccactgctagtttgaatggcgtatctgggttaacggtctctaaaagatgagagaccgtttcaatccgccgggtccgactgttggaaaccacgccttggttggtggtgatttcgtagtaaagtccgcgtttctcgagttggtgcatgattaactgcgcgttaggcttagtaatcggcacttcatcaagaattttgccttcggtgtcaaaaattgcggcaccgttgagggtgataagtggtacggaaagcccgtaagtctctaaaaggggtttcgcttcacgatattcgcgacccgttgccacgacgaaatgaactccggcgtcctgcgcttttttaatcgccgcagcattacctggtgaaatttgcatttcttcgttaagtaacgttccgtccatatctgaagcaatcactgaaatcatgttatgcacatccaatccatatatttatcctaattttaacatgaaccccgccatttttttcagaaatcagttagaatggaagtaacaaattgttcgaggaagattgaggtatgaaaacaattattcataacgattggcagaaggttttagaaagtgaatttgaaagggattattacgcaaatctccaccaatttttaaagcaggagtacgcaacccaaaatatccatcccgatatgtatcacattttccaagcattcgaatggacgccgttttcagaggttaaagtggttatcttagggcaggatccgtatcatggtcctcaccaagcgcacggattaagtttttcggtgcgcccgggagtgccggtgcccccgtctttacaaaacatctacaaggaattacaggatgatttaggagtcaaaccggtacaacacggatacctgaagaaatgggcggaccaaggagtactgttgcttaactctgtattaacggtccgcaacggccaggccttttcacatcaaggtcacggctgggaacgtctaaccgacacggcgattaaacggttgtcggaacgtgaaaagccggtgatctttattttgtggggccgggccgcgcgtgacaagattaagttaattgaccagtcccgaaacattattattcaatctgcgcatcccagtccgttatcggcataccggggcttttttggctccaagccgttttccaaaactaacgctgctttggaagcgatgggggaaaagccgattgattggcaactaccagaacacgtagaagaggaaaaataaatgcaaacttatcaattacgaaacgaagaaatgaccattgaatttggcaaaatgattggtaaacttctacatccaaacgatgtggttgtgttagacggagatctcggagcagggaagaccaccttaacgaagggcattgcccaagctttagggatcaaacgctacgtaaaaagtcccacctacacaatcatccacgagtaccatgacgggcggatgccgctttatcacattgacgcgtaccggttagaagatgggaatgctgatgacattggtttagaagaatattttgaaagcgatggggttaccgttattgagtgggcccagtttattaaggaatacttgcctgaagagtacttgaagattggattggaccggaaccacgataatacccagcggtttctaactatcgaacccaacggcgaacggtaccagcaatttgaaaaattccttgaggatgaaatcaatggccaatagggaagatgaagtttacctaacggagggaactcccgaggacgcccaagcgatcgtggggctaattgaccaattagaaacggagacggattcaattgagtttgacccgaccatccatcagctggagctcaagctggttcaacaaaatttagcgttaattcagcaaagtccgactaactttttattgttggcaaagttgggggatgctccaatcggcttgctgacgattgtggaaacggacgctaaaaaggggcaggccgagttgggagtcggcgtgcttgaaaaatattggcacaacgggattggaaccctattagtcgatgaagcattatactgggctaaaaattacagctccttatcgaccatttggctagacgtcctgacggataacgagccggccatccacctatacgaaaagatgggctttacaactaaaaaagccccgatcaaggatgatcagggtcgtagtttaaaacgaatggcacgtaagcttagctaactttacgaataaagctactgatggcgtccgcaccgaactgcttcttctcatacaacaagatgttcgcgcacgccaaactatcgtctaaggcgttgtggtggtgctctaattcaatccccaaattatcacagagcgtgttgagcttgtggttaggataattagggaaaaagctgcgggaagtccgcaaagtgtccaaagtttggtaaggcagccggttaagttcgtaacgctccagcgtcttctttaaaacgctattgtcgaagttggcgttgtgggccacgacaagttggtcgggagtaaagaacggctgtaaaattggccatagctccggaaaggtgggcgcgtcctggacgtcggcttcgtggatcccgtgtacttgaacgttccgccaatgaaatttggtttccgggttaattaaagagtacaattcgtcggtgatttgatcattttgaaccaccgtcagcgcgattgaacaagcgcttgcccgcgcaggcgcggcagtttcaaaatcaatggcaacaaagttcaaaaatatcactgtccttatattattttaagtcaagtttaacgaataaagattagtgcgtaaaggagtttttccaatgattaaagttggggtaattggattgggaaacatcgctcaaaaggcttatttgccggtagatagtcagttacaagatcgcttcgagtggtacttagtcagccggcaagccgaaaaattgcaatatttgcagaaaaagtacggttttcaacacgggacgacccggatggatgatttgtttgaggaaaacgttcaggcggtgttcattcataccgctacctccacccattacgcgattatcaaaaagtttctgcaacacggggttcacgtttatgtggataaacccatttcagaaaatttggcggaggtgaaagaactttaccaaattgctgctgagcagcacgtgttattaacctgtggatttaatcggcggtttgcgccactgcaccaagcgttcgggcaattgggatccccgcatttagttcgggcaactaagacccgggtgatggaaaatcaaagtccccagtttgccgtttatgacctaatgattcacgtaattgatttggtccagtttttaatggaatcatcaaaagtggaatacgtggatggccgcctacgagaacaggatggtcagttggtctgggcggaggtcgaactaaccaacggggatgcttctggcgtggcccaaattgatttgcgcgctggtgcgaatactgaagtagcagaggtagttagcgatcacggcgtcgcccgagtggaaaacttacaaacgttaacccatgatcacgacgggaaacggacgatccaaagtacgccagactggcaaaaaatgctggtaacccggggatttgcgccgttaattgaagcttttttgcgggcggtggaaaatgacggtcccaacccggtatctccggcttcggtgattaagtcccatacgctatgtgaccgtttaatccagagtatgaaagtgataaaataagcgaagagattttcgatgaatcgtgaggattcacaatgtaaatgaggtaagaggggaaagtatgatggatcaatcaataaccgcggcatttccagaaattaaggtctacaaagatgaaccgttgtcaaaatacaccaatacacaaacgggcggaccagcggatttgctagtatttcccaagtcggtgactgaaactaagcagttgatgatttgggctaaggaaaccgctacgcccctaacggtgattggaaatgcaagtaatttgattgtgcgtgacggaggaattcgcggactagttttaatcttaaccaagatggacaatatccaagttaacggcaataccgtgattgcggaagcgggggcggctttaattcaagccaccgaagtagcttaccaatcaggattgaccggttttgagtttgctgctggaattccgggttcagtaggcggtgcgattttcatgaatgccggagcttatggcggtgaaattagtgaaattgtggaaagtgccgaagtgttaacgccagatggccaaattaaacggctgaataaccacgaattggattttgggtaccgacacagcagcgtgcaggattatcacgatgtggtaatttcagcatcatttaagttgcgtcctggtgatcaaactaagatccgggcgcggatggatgagttaaaccggctccgtgcttccaagcagccgttggaatatccatcgtgcgggagtgtgtttaaacgccccaccggttactttaccggaaagttaattcacgaagctggtttgcaaggcttcacgattggcggcgcccaagtttctaaaaagcacgccggattcatcattaacatcgggaatgctacggcaactgactacttagacgtgattcaccacgtacaagccacggtatttaaacagtttggggttaagttggaaaccgaagtccggattattggtgaagaaaaataaattgaatatttaaacgaagtgacctccaatttggcaaacgggtaaaatgcaattgggcacatttgaagcgtgaatgtgcgataaattaaccccctgcaacaaataggaggtcactttatattctctctggtataattatccctgaatatgaatttggagggacaggtatgaacataaattggtcccagttgttaacttggagcgatgtcatcaatattattgatgtactcgtggtttggtttgtaatttatgaattgattatgctgctgcggggaaccaaagcggtacagttatttcgtgggattatcgtcattattataattatggcgggaagctggtatatcggattaagcacggtttactggattatgaatcaggtcatcaattggggagtaattgcgatggtgatcatctttcagccggaaattcgccggggactggaacacttaggtcgcgggtcgatttttgcaaagaaccattcgcaaaaagaagcggaagaaaaaatgattcaggcgttggataaggcgattcagtacatggctaaacgccgaattggagcgttgatttcaattcagatggaaaccgggcttgatgactatattgaaaccggaattcccctggatgcggacgtttcgggagagttgttaatcaacatttttatcccgaacaccccgttacacgatggtgcggtgattattaaaaacggtaagattgccgtggcagctgcctatttgcctttgtcacagagcaacttaattcctaaggaacttggaactcgacaccgtgcggcagtcgggatgagtgaagttaccgatgcattgaccatcgtagtctcagaagaaactggagaagtttctattatgaaggacggcgaactattgcgggatatgtcgcaagaatcctacttacggtatttccgaacccaattaattaccagtgatgaagggcccaccccgttcttcacttcggttacggaaaatatttcggccttctttaagggaaaaagggggcggcactagatgaaaaaattttttaccaaaaattttagctatcggttaattgcgttagtcttagcccttttgctttttgcgtacgtaaagaccgatcaccttacttcaacgcgggtttcggggaccgacgcaaaccagaataaaaccgcgttgatgtctaccaagacggctacaattacgatgccggtggatttagatgtggattcaagtaagtacgtagttagtggataccaagaacgcgttaaaattacgctgaccggctccagcgcaatgattactaccttaaccaacacccgtaattttaaggtgtaccttgcattgcaggattatgcaccgggtaagcatacggttaaatatcaagtggaagggctcggtaaggatattcgttaccgaatccaaccagaaaaatcaaaaattacaattgcccaccggaagacgaagaaatttgaaattcgctaccgttacgatactaacatggttaaggaagggtatacgatggggaacgtaaagacctcggtaacgacggttcaagcaacgggctccgcatcagaaattgaccggattagccaagtggttgccgacgttaacgtccctagcaacacgacagaggatatttctgcgcgttctgtgttgcaagctttggactcaaacggtaacattgtaaatgtagtcttgactccgcaatcggtaaatgtcactattccagtttccaaggcgaaaacagaaaaagccaaggaatctagtgaggcaagcagtcaagctacgtcctcttctagcagttcggaaaaatcagcaagtagcgcatcctcatcgagtagtgaagaaagttcttcgagttcagcaagtagtgacgagagttcgtccgctgacgatactagcagtgatgggaatccgcagctccaacagtgatgcataagtgaaaactagcttgggagctgtgctaattagattgctgattttataatttagataatgagttaaaagagattgacggcgggctacaggtcttgtcgcaaagaaggagattttcaataatgaaattgaagtattttggtacagatggagttcgtggaatcgcaaacgaaacgttgacaccagaactagctttccaattagggcgaactggcggatacgtattaacgaagcacgccaaggatgctgatcagcgtccccgggtactggtttcacgagatactcgagtttctggccagttgttaaaacacgccttgatttcgggtcttttgtcagtaggaatcgaagtaatggatatgggaatcgttacgacgcccggggttgcttacttagttcgtaagcaggaagctgacgcgggagtgatgattaccgcttcgcacaatccagtagaggataatggaattaagttcttcggttcggacggttacaagctatctgacgaattagaagctgaaatcgaagttctcttagatgctgaaaaagataaccttccccggccatcggctaagggacttggttccgtaacggattaccctgaaggtgggttaaactacacggcattcttggaacaaacgattcccgacgacctagaagggttacatatcgcggtggacgctgcgaacggtgctactagcggctacgtttcccaaatctttgctgacttaaatactgaatttgaaacgatggcaaccaatcccgatgggttaaacatcaatgcgggagtcggctcaactcatccagaagctctagcaaaattcgtggttgaaaagggcgcggatatgggagttgcctttgatggggacggcgaccgttgtattgcggtagacgaaaagggaaatatcgtcgacggtgataagatcatgtacatttgcggtaagtttctaagtgaacggggtcgtcttaaggaagacaccgtggtaacgaccgtaatgagtaacctcggaatgtacaaagcgttagaaaaacacggcatgcattcggttaaaacccaagttggtgaccgttacgtggtggaagaaatgttgaaggatggttataaccttggtggggaacaatccggccacattattttcttagaccacaacactactggggatggcatgcttacggctatccaattaatgtacgtggttaagcaaactggtaaaaaactttccgaattagctgctgaagtaactacgtatcctcaaaagttagttaacgtacgggttcaagataagaaattagcgcttgaaaaccaagccatcaaggacattatcaaaaaggttgaagacgaaatggctggcgaaggccgggtattagtccgtccttccggaactgaagacttacttcgggtgatggcggaagctcctactgaagaagcggttaaccaatacgttgaccggattgttgcggtagttaagagtgaagttggcgttgattaacggctgtaactaaataataaaaaacgaaacgggcggagaaaatctctagcccgtttttgattgtctaataaaatgagtttggggtaaaaaatttaaaggggtctaaccccttgtgctatacctattcccacatttgatatataccaattacgaaaaataatgtttgacaatcgccttaagcggtaatatattaagaatcgttaattataccaattatataaaaacaaatagatgaatttaggagaacagggattatgtgtggaattgttggagtaacaggtagagcagatacgaccaaacttttagtgaacggtttgaaaaaattggagtaccggggatatgattctgcgggaatttacgtaaataatggtcaaggcaaggattacctagttaaagcgcaaggaaagattcaaaacttagaagatcaactttctgatgacgtgaacggcagtgccggaattgggcacacgcgctgggcaactcacggtattccgagcgtggctaatgcgcacccgcatttttcggcagacaaccggttttacctcgtgcacaatggagtgattcaaaacttcaaggaattaaaacaaacttatttagcagacgtgcctttccaaagtgataccgatactgaagtagtggttcaattagttgaccacttcgctaaagaaggtttatcgaccatggccgctttcaagaaaactttaagcttgttgaaggattcttcatacgcctttgttttaatggaccgggaaatgccggacaccctttttgtagccaagaacaagagcccgttattaattggggtaggcgacgactttaacgtagtttgcagcgacgctttagcaatgatcaacgtgacgaaacggtttgtggagttgcacgatggcgacgtggttaaaatcacccctgacaaagtggagctatttgatgcagatggtcaagcaattcaacgggatccttttgaagttgacattgaccagtccgatgctgataagggaacttacccatactacatgttaaaagaaattgacgagcaaccagccgtaatccggcgcatcgaagaaaaataccttgattcaaaaggcgcagttcgtttcgataaagcaatgttagataaattaaaccaagccggtaaaatttacattgtgggtgcgggaactagttatcatgctggtttagtgggcaagaagttattggaacgctttgccaaggtgccaacggaagttgtgctagcatccgaatttgcctacgacgatccaattattgaaaaagatgccttcttcatcttccttagtcaaagtggtgaaactgctgatagtcggcaagttttagtccgggtaaatgatgaatggcaaaagccaagcctcacgattactaacgtggctaactcaacgttggcgcgcgaagcagaattttcggcaaccttagaagcgggtccggaaattgcggtagcgtcgaccaaggcctacaccgcgcaaattgccgtagaagcacttctagcggtagcaatgggacggatgaagcaaatcaatgcggcaactgattttgacattgcaggacaattaagcatggtggcaaacgcaattcaaacggtggtggatgaaaaggcagctatcgaacaattggccaaagacacccttttaaaggcgcgtaacaccttttacattggccgggggctagattatgcggtagccctagaagcttcccttaagcttaaggaaatctcttatattcaagcagaaggttttgcagccggcgaattgaagcacggcacgattgccttaattgaagaagggactccggttatcgggatcattacccaaggtaaaactgccgatcacacccggagcaatttagaagaagtgatttcacgcggagcacaggtaatcaccttcgctagccaaagcctcgccaagaatacggatgacgtaattcttcctgacgttgatgaaatgttgatgccgttggttagcgtcattgctgctcaattattggcttactacgcttgcttgcagcggggttacaacgttgaccaaccgcgtaatttagctaagagtgtcacggtagaataggaggaagagcagtgcaaagtcgcctgaattttaatttgaatatttttgaaatttaggttgacattattatgtgtaagcgctaacatatggttgtaaggtagtggcgcatctcctacctgcacaatcaattctctttctctcttatgctggatccgactcgtacaagtccggatccttttttggtgccataataattctagacaggagtcggtaacgcactttatactagataagtggaggcgagagaatgaagagtaatgagacattcaccttgattcaagagattacccgtttggatggtactaaatacattgaaattggtaacatgatgatgaatggtcgcgctgagctagcggccgaacgtggttatattaaatcagtgcggattatgcagctgaacatatcgcattcgcaacatgtaattaattatgaaaaatacatcggggaacgctacgaaatgcccgacgaaaacatgacttcgtgggaagaatggcaaaaagatgaccggattatgaaggacttcaacgcgattttacacgaaaatcatatcagtgctaataaagaataattacttggcttttaaggcccgtttttgcattatacaattcaagtaattcaaatgcttttctggaatttcttaattctgggaaagtattttttggttttcgcagttctttttttgtaccagaaaaaataatttttatccgcaagtgtaaacgctcgcaaaaattcgcttttcgtgttaatctattcttgaatttaaatataagaataatcaggtttgtttccacaagggggaatcgatgatgagaaaagcgtttatgattggtacaggagttgcaaatttagctgccggcgtatatttgattcgtgatggtggttggagcggtaatcaaattaccatgttcggactcgataaacacggggctaacgatggggcagcggttgcggattacgagacggaatacggcaaccagcggctatctaacgatcggggctttttagccaagggcggtcggatgcttaacgaagagacctacgaaaacttgtgggacgttttgcggagcgtgccgtctttggatcacccagggcaatcggttacggatgacattttaaactttgaccatgctcatccaacccatgacgtggcccggctaatggataagcgtaacgggatccggaataatggcggtgcggacgactattcgcatatgcaatttaataaccaagaccggaagttgttaaccaaattaatgatgatgcctgaaagccaagaagcaaagcttaacgacgtcagcattgcggaatggtttaaggatagtccgcacattttcactactaacttctggtacatgtgggaaactacctttgcgtttaagaaggaaagctccgcaatggaattgcggcgttacatgaaccggatgattctggaatttagtcggattaacacccttgaaggggttaccagaacgccgtataaccaatacgaaagtatcattctaccgatgcgtaagtacttgagcgatcacggggttacctttatcaacaaccgtaagattaccgccttccaattcaaggacactccgttgcgcgatgatatcatcgttactggcttagagtacgaagacgtaggggaaaataagcaaaccggcacaatcccggttgacgaaaatgacctcgttttcgatatcaacggcgcgattaccgatagttcatcgattggtgatttcaacaccccaattaaggaaaatatggaatacgctcctagcgcagcattatggaaacaagctactgaacatttctataatctaggaaatccggacaagttctttaacgaccgtgcccaaagtgaatggatgagctttacggtaaccacgaagaaccactatttggtaaaccaaattagccggattacccaacaaaaaccggggaatgctttaaatacttgggtagacagtaataatttgttatccatcgtggttcatcatcagccgcatttccacgctcaaaaggaaaacgaaacggtcttctggggctacttcatgttcccacgtaaaaatggggattatgtggacaaaccggtaattgaaatgaccggaaaagaaatgctacaagaattactaggtcatttggcagaagttgatcaagcaacggatagcattgtttatcatgaagaggaaattatggatagcatcgttaacgtaattccggtttacatgccgtacgctagcgcactgttcaatacgcgagctgtcggagaccgtcctgaagtagtgccaaagcattcgaaaaacttggcatttgtcagccagttcgcagaaatgccatttgacatggtctttaccgaacaatactcgttccgggcggcacaacgggcagtctaccatttcttaggaattcctgaagaaaaaatgaccccagtgcaccactacgagaagaatccaaaggtgcttttgaaggcaacccggaccatgttccgttagaattatctatttaataatactaaaagttgatttgagagcttgattttattaaagcgccaacgaaatcagctgttccgcttaacaaaaaatcgatcgttatgccaatttaggcaacgatcgatttttttgttaatgcttgtaaactacccgacttttgtcctactcttagcattttgggttaggacttagtaaagttttcaagtccgtcacgcgtacttttactacttacgggtgattttggggaggacgtagttttggtagtaatcttggtaggtttgtttggaaatttggccccattgttcttggctgaattccttaattttttcggtactaaagttagcctctttaattgcgctgattgagaagacttgggtttggtcgccgacacttagccgaattttcttcaacgaacggggaagcgtgtcgccctggattttcttcagaatatggaccatattgggtgcgtaaagctgggtgaaatcaaacaagtttaacttagggacccgaatgataatctgggagtccgtaaagttaacttgaaaaggcaggcgaccgttaaaactatccgcaatttgattttcaatcaaggtggcctcattggaggcgttttcctcgccataggaatcagtatttgaatgaatatctaattgttgattggtaaaattagggtaagtttgaaagcccagaattgccaaaacaactacggttaagttagatttagaaaagattctgggacgtttgaatttctttgctttagccatgtcttatatccgttcataataaacccgttaaacgtaattacgtttaataatttcaacaacatcaacaattatagtaaatttaaggtatttacacaaacgtttgtttgctaaatgttaaaggataagttacgatagatgaaaaattatttaaggggtaccggaatgttaaaatacgcgatttttgatttagacgatactttactggattttaagaagggtgaacgtatcaaagctaccgaagttttacgtaaatatggcgtgcaagatttgacgaccggattggcaacctacacaaaaattaaccagcaggtctgggaagcaatcgagcaaggtgcgcctcgggatcaagtgttgaaaacccggttttcgaaaacctttgcggcactcggagtggatggcgatggggtcgctgctgaacgggaataccgccagcgattggcaactagctactaccaatttgaaggcgcgcaagtattactgcgggatttgaaatcggcaggaattcggttgatggtgggaactaatggggttaagaagactcagttgagtcgactcgctggttccaagttagaccaatactttaccgactgctttatttcagaagacgttggttatgctaaacctgatgaacgcttctttgcgccaattaagcataaatatgcggatatgagtttccagaataccgcaatggtgggcgaccggttgcaatccgacattttaggggccaatcaagccgggctcaaaagcatttggtataatccccaacaaatcgcggtggatgcgccaatcaagccaaccgcggtggcacattcttatgaccagttgcgggaattaatgttgtaaggcgtgcttgaaacaacaaataaaaagagataacttacgaaattaagggtccagcaaaatggaacttgaagaatcaaaaatttgaatttttttcattactaaatagtttaaaagcagtgtggaggtgaaagagcccacactgtttttttattttagaaaaaaatgttgacttattatctgaatgcgcttacactatctgtgggctcaaaaataaactaacatgttactttgaatgctttgacttgttaaaaaataagctttttaccaagtttataaatacaaaataagcattttaagtcccaagggagtattgcaatggagtataaagatatttcaccatcaaccgttattgaagagttacttcgggaaatgattatggaattaaaggatggcgatcaattgccatcgcaaagagaattagcggagaaattacaagtaagtcgtaacgctgtcaaatatgcgttagcgagattacaaaaagaaggtgatattcgggttaaaaatcgtcaaggaattcgggttaacaagaaaatagatgttaatttgctaggaatgcgcccgttaagtagtgaattaggagaatcaaatgaacaaattcaacagctttccgcaaaagtaattaatacaccaaatagtttagaaagcttttttgaaagttctactaagcaaacgttagagcttaagcgacttcgtttgtacaaaaaccagccgttttcatttgaaattgcatatctagatgcaaagcgtttcgagaagttagtgaattttgattttaataactattcgctttataaagccttaaaagaaaattatggggttcaacccacgtacggctatgaaaccatcacgtgtgtgttagcagacgaaagtttaagacgcacattacaagtggaagagggaaaaccgttatatcaagtagacagttttaactacgaagaaaatgatgttccagttgaacatacggtgcagtaccttattgggagtaacttcaagtaccacttcaaggcaaagaatatttttgattatcaagaggatttataaaatgacactatttaaagaaatttacgctgatatcaaacgcaaaattgaaaatggggtatacaaaaagggtggagttttaccgaatgaaggtgagctacaaaagatataccaagttagtagaacaacggtgcgtaaggcagttgagcgactagttgaagaaaaacaagttgtgcgtaaaaaaggcgtgggactatttgttgccccaggaatttctaagcaaaatattttggatatgaccggaattattaaaacttctactgggctagaacctgagaaaacacagattaaggaaagctacttgcgtaaggcaggggtttactattcaaaaatctttggaatcaaagagaatgaattgatttattatcttagttttttagtgttttccgaaggtgaacgcacgtatgaaaagttaattttgccactggattattttcccggctttgatccggagatattgaaggttaccgcaattattgaagcagttaacactggcaaactgagtgtccaggatgtttaccaagattttcaattaacggaagctaccgatgaagattataaacagttagaagtggcaactgactttccagtttttaaaataactaatacctttttagacgatcgggcacgagtagttgccattgaatataaattacagagcgctttagatactaaatattcaatagactttgattaaaagtgagggaatttaaaatgataaaacttgttagagtagatcatcgattattacatggtcaagtagcggtttcttggtttaacagtttgggagcaaacactatcttggtggctaatgatgccgttgctagcgatgattttcgtaaatcggcaattcgattggcgaaaccagataatgcaaagttggtgatgaaatcaattgaagacagcattaaagcaattaattcaggcgtcactgataaatataaaatgctagtggttgtggaatcagttgccgacgctagcaaactaattcaagaaaccgacggaaagattggggagcttaacttaggaggtactaagccacgcgaaggaacaattaattattctaagacaattaatttgactaacgatgagggagcacaattaactcaactacaacaaagtggtgtggacgtttatatccaacaagttcctagcgaagagcggcaagaattcaaaaaaatagattaattatggaggtgtaaaaatgagtgcctatttaacagccttactgctagctttgattgctatgttggggaacggagagtatttcttaggttcgtccatgctttctcgtccgttagtaatgtgtacgttagctggtctaatcatgggtaatgtgcaacaaggaattattatgggagcaactctagagctagcttttgtaggttccttttcaatcggggcatcgatcccaccagaaattatttcaggaagcgtattgggaactgcatttgcaatcggagctggtaaaagtacggcggttgctttaacgttaggaatcccgattgcttcgttagtgctagtaattaaaaatctgtgctttatctttattttgccgtactttgtgcataaagcagatcattacgcggaacaaggcaataacaagggactcgatcgaatgaatcttcttggaggatttttctcaattaacttaccaattggattagttgtaggagtttcctatttgctgggtagcccggtaattaaatcatttttagcggtaattccacagttcattatcaatggtttaggtattgcaacggggctcctaccggcttacggttttgcgttacttttaaagatgatggtcaacaaaaacaacattacgttctttattttaggatttgcactggctgtatacatgaaaatcccagttaccggcgtcgcgatttttggagcatgtttagctttgattttaacgggttactcagcatttaaggataaatttcatgctgaaccagcagctgtaagcggaaattcaactacgaatagtgggcaaaatggaggaatcgattatgaagatgaagagttctaagttacttacgaaaaaagatctaatggcaaccttctggcggtcgtttaccatggaatgggcttggaattacgaacgacaatctaacttaggatattcttacgcgatgactccagctcttaagaagatttatcaaaacagagaagacaagttaaaaagttcgtttaagcgacacttggagtttttcaacgttactccatggttaagtacttttccgctaggcatttcgatcgcaatggaagaacaaaatgcgttaaatgacgactttgatgaagattccattaataacattaaaattgctttgatggggccgttaagcgggattggagattcatttttctggggcactctaagagttattgctactgggatcggaacctcgttagctttccagggaaatatattaggaccattactctttcttctgatttttaatattccggcaatcattgcacgatattatggcttgttcattggatataacattggagcgtcatttattgaccgggtgcaaaaaacgggattgatggataagttaacgtatggtgcttctgttttaggcctcggggtggttggagccatggttgctacaatggtaactttgaaaatgccaatgaaaattgggacaggggcggatgccacttccgtacaaaagatttttgatggcatcgtaccaggaatattgccgttattatttacgctatttattttttggcttgataaaaaaggatggaaagcacagtacattttgttattgattgcggcaatcggaatttttggcgcttggagtggattacttggttagtaaatagagaggagcaagatagtgaaatcgattaatgattatgtgcatttggaaccaaagctgtatcaacaagttcttgataatgttgaaaatttatttttgaaaccgcttaatcagtggggcttaagtaagtttaagcgagtaatgatatatgcaacgggctctagttcaaatgcggcctttggtgcattaccactgatgagcaaaattctagggatgcctattcaagttgaagagccttcaatatcagaaaattatttaatgaatattgaaaacgacaccctttgtttagcaatttctcaaggggggcatagttattcagtagttaagctagttgaacggttgcaaaagaatcaaaaaatggtcgttgccttaactagtgaaaaggatagcccattggcacgagttagcaaccgggttcttgaaatgggaatgccggtggaagaaatgccatacgtcagtgcaggatatagtgtgactattttagatttaatcttaattgcgctagtgctttcgaaaaaattagggaaaatatcggctgaagaggatgagaagtattggcaacttattcaagaaatcacgaaaaaattgccacaagttattaaacaaagcgatcagtgggttgaaaagcatgtggatgactttagtaatgcacaaagaattacttttattggttatggtgcagcttacggtgtcgctcgtgaaggagaaaccaaatttactgaagcagtacggaataacgcttggggaaaagaacttgaagaatatatgcatggcccatatttaggacttcacgctgaagacataatagttttcatagagccgaatggtaaattagcggatcgtgcacagttattaaggaaattcttaaaacaacatgtcaaccatgtttacacaatttacgcgaaccaagttaatttgagtactttgacaaccggagatttagcttttgaaatagcaactgatgaactactggcggcattatttttaaccgtgccaatccatttaatggcctatcgacttttccaaattaagggagttgatttagaacattcggcttatccagattttgatcaaattacagcttctaaaatctaattaaacaataaaggagagaacatcatgagaaaatttaacaaacaacaattagtcgcaggtatgcaaggtgcacttaaattacggagtgaaatcaatcaattaatagaccagattgctgatcaaggatatcgtaacgtttgctggttagggattggtggtacctatgcatcctcaatgcaagcagtagttcatatgaaagaaaaatcgggaattgaaacattttaccaaaatgcagctgaatacctaacgaccgggaatcgccgaattactgaccaaactttagtaatcacttcttcagttactggtaatactaaggaagtggttgacgcggtaaaacaaattaaagcaacgggagcgactattctaggttttattgatagggctgaagctgatttggcaagtttagtaacccattgtatttcttatccagaaaatgagcagcttaaattcttcatggttgcggatcgtttaatgtatcttaaaggtgaattcccggaatatgaagaattctatagtgaaatggatcaacactttgctgaagatattgcgaatattgaagaaggtgcggacaaatttgctcaagaatttgcgcaacaacatcatgatgacgacattcattactttgttggagctggtaatcaatggggcgcaacttactcatacgcaatgtgttactgggaagaacaacattggattcggactcgtgccattgaagctgctgaatttttccacggaatgtttgaagtagttgaccgagatacgccagttacagtttatgttggggaagatagccaacgttcgcttagtgagcgagttgctaaattcctacccgaaatttgtggaaattacacaattattgatactaaagactatgatttaccaggattttcagaaaaattccggggcaccctatcaccatttgtcttccatgcaattaacaaccgtattgatgtaaatattgaacatatcaatcgtcatccaatggatattcggcgctactatcgagctttagattactagaagtggagttcaactaatgacatcagtattaatatgcatgcatggaaaatcagccaccgcaatgcgggattcggctgaaatgatctgtggtaagcaagaaaaatgtgcggccgtagatttcaaaatggggcaagatttagcggatttcaaagcccagttaaaaaaagaaattgcggaattagatggatctccgatttgcttaactgatttaaaagggggcacaccgtttaacacgctagtgacgttgaccaaagattttcctgctttaaaaatcattacggggacgaatattccaatgttgttacagctatttgtttaccggacccaattcgataaagctaatttggttaaggaacttttaagcgcgggccaaaaaggaattttccaatacaccatggttgcacaaggtgacgaggaattttaaaaaaattcttcgggaagtgaggtaatagtttggttactaattaaaaatagggaccttcagtatttagctgaaggtccctattttattttggaaagatgtcatgcgtaccttaaagaaaaccttgaaagtgagctagctaaatttttagaaaatccattgttgatttttatgtcgataacgtcatataattacttttgtcgataacgacataacattcaaaagcaggtgaagtaataatggaaaaacaatttaaaactttagaagactttttaggaactcactttatttacacatacgataatggttgggaatacgaatggtacgctaaaaatgaccatacggtagattaccgaattcatgggggaatggttgccggccgctgggttaaggatcaagaagccgacatcgtaatgttgacggaaggtgtttacaagattacttggacagaaccaactggaacggacgtggcgttagacttcatgccaaacgaaggtaagttgcacggaaccattttcttccctaagtgggttgaagaacatcctgaaatcacggttactttccaaaatgaacacattgatttaatggaagaatctcgtgaaaaatatgaaacttatcctaaactagttgttccagaatttgctaaaattagttacatgggtgatgctggacaaaataacgaagacgttatttctgaagaaccatacgatggcattaccagcgacattcgcaacggaaagtattttgatgaaaactacaagcgaattaataagtaattaatttttggaggagttcgcatgccacgaccacgagttttactgtacattgttttaggattgttaaataaaaatggggttatgtctggaaaagatatgattgcggaatttaagaacgaaattagcgagttctggacggtttcacacagccagctgtatcctgaattacaacgaatgacggacgaaggccaaattgaagtggttgacgatgaacaaaatcggaaagtcattaactacgcaataactaagaagggccaaacagatttgcgggaatggctcgctaccccgatcacggccaaaaatgatgaactgacgtcacttaaaatgtactttatcgctgaccgacatgatccacttttacagcaaattttaaaacaggcggcggaccttcacgaacaaaaagtggcccacttaaagcagcggcaaaaattactgtttgaagaaccatctgcgattgaggaaaattacggacattacttaattttgtcccgggcggttgaaagggaagcatcccatttagcctggctaaaaaagcacatcgaataatccgaaaaacaggtttacaagtaggtagacgtgggaaaattcgggcggcttgcgagcgctaacccaaaatcggtagttgtgcctaaattgggcgtaactaccgatttggggtccttaaaaaacgtcgtcaccaaaacagcactgagaagtttgcgaactctcagtgctgttattttaatatccttatttaattaacctttaccgccttgaaaggatggataaagagtcatcccgccatcaacgaagagggtaattccggtgacgtaacttgattcagcggaagctaaccatgctgccgcagccgcgacctcttcaggatcgccaattcgttgcatgggaatcatgctggtggtggtttttaactgttcaggatccgcaaattttttagcgttgatgggcgtattgatcgcgccagggccaattgcgtttacccggatgtgccggtcggcgtattccatcgcaattgtttcgttgaacagttttacgccgcctttgctagcagcgtagtgtgcaaaagttggccacggaattttctcatgaacggaagacatattgataatatttccgggcttatcatgcgaaagaaaataattaatggccgcttttgaacctaaaaacacgccgtttaggttgacgttgagcactcgtttccagctttcaaacgataattccgcagtcggttgttgattttccatccccgcgttgttgacccaaacgtctaggtcgccaaattgatcgacggccgtgtcgactaggcgcttaacgccgtcttcggttgatacgtcagcttgcacgaccacgccttcaccgccggctgcgttaatttgatcccgtacggcgttggcgccatctttatcagagttgtaattaataacgacgtgcataccttcttgcccaaagcgttcggcaatcgcgctgccgattccttttgagccgccagtaatcacggcaacttttccatttaaatctttatataacatagttactatccccccagaacataactgtaaaataaattcttgatgttcgtaacgtatgataacatcagaaatcacagtaagggaactgaaacgatttggcgttgcttaccttatgcttagcctaatatttttgggggattgttgctatacacaaaggcaaaataaccctgtaaaagcaaacttgattttatagggtcgatgagttttaaaaaaggtggagtgattggattaaaggcaataaaattaacaaaataatgatgataatcatgcttaatccaaagaaattattcgggttaaaggtcaccccaaagccaaatactttggggattaagagtggcgaatgccaatcgaggtggagatttcggtcatttttaagccaggttacgtaaacggtcgccaggatgagacagatcgccaaaagcaatacgaaactaaccataatataatactctgtttcgggaaaatatttgagcatagaatagcatactaaaggcgtgaaaacaacgaaatcccaatttacaaaaataattttctatgctaatcttgaagctagctagttgaatataatcaaaaaccgtaagaagaacaagtattttaagcccgtaacttaaagcgaattgaggatggtggaagctcaagaagttattcttttaagaaaaacatcttctttgtttctaggctgaacgattaagcgtccagtaagtctagacgtgaccgatacgttatcgtttggagagcatattttagatgtgcttttagagatgtttatttttaaacgaattttgggtggtaccgcgaagtctttcgtccctgttacgggatggaagacttttttattggcggactttttacgaagacaatggagggatttttaatggaaaatacgttggttaaatcactttatgcgcaagcaacgcatgatgaagatgtagcagtagaagtaacgggttggctaaagacgctccgttcttccaagaaaattagctttttggaaattaacgacggttcctgcattaaaaatgtgcaggtaatcatggaaaatgagttggagaactacgaagaaattaagaaagctcccatttacactaccttaaaagtagtcggaacggtagtggacactccgaaagctaaacaaccgtttgaaattcacgcaactgaaattgaagttttaggtaactcagacagtgactacccacttcaaaagaaacaccacacaccagaattcttacgtgaacaagcacatttgcgtccgcggaccaatactttctacgcagttttccggattcgttcgttggcagcctttgccatccacgaattcctccaaaagaataactttgtctacgttaacactccgttgattacttctagtgatacggaaggtgccggtgaaatgtttaaggtgactactttagaccttaacaacgttccaaagaacgaagaaggcaaggttgattctactaaggacttcttcaagcaaccaactaacttaacggttagtggtcaattgaacgcggaagcatttgcgttggctttccgggatgtttatacttttggtccggctttccgtgcggaagattcacacactacgcggcatgccgctgaattctggatggttgaaccagaaatggcgtttgctaacttgcaagacgtgattaacgtttccgaagacatgttgaagtacgtgatcaactatcttttggaaaatgcttctgatgaaatcgactttttgaaccaaaacgtggaccaagaattacgggctcgtttggaagcaactcgcgacgccgattttgcccaaattacttatacagaagcaatcgacaagttgttagctgctgaccaagaattcgaaaacaaagttgaatggggaattgatctccaaactgaacacgaaagatacttgagcgaaaaagtttaccaaaagccagtgttcatcacggattacccacgcgacatcaaagccttctacatgcgggaaaacgaagaccacaagacggttgccgcagtggacttattagtacctggcattggcgaattgattggtggtagccaacgtgaagaacgactagctaagttgaacgaaaagattaaggaatttaacttggatcctgaagaatacaagtggtaccttgaattgagaaaatatggggaaacagaacactccggatttggaattggtttcgaaagattattgatgtacgttactggtgtggaaaacatccgcgacgtcatcccattcccacggaccccgggtaacgctagcttctaattcaaaacgttaatagtaagcaaaaagccttgaatttagtcagacgatgacggattcaaggcttttttatgaataaaaaatacttctaatttccaataaaagtggaaattgattgtgattacaaatattaaagcatcacttacaatgaaaatgtaatcggttacaacataagggatgcagtaggaggatagctcgatggtaataccgtcaacaaatattttcttggataaaaacttttcaaaaaaagatgatgtgattcattatattgcaaataaagcagataaattggaatatactcagtcatcaaaagatttatttaatgtgtttaaagaacgagaaaaagattattctaccggtttacaagaaggttttgcgattccccacgctaaatcacgaatagtaaagaaacctggaataatatatgttcgatcaaataccgggattgaatgggaaacatacgacaatcaagctgttacagacgtatttgctttaatggtaccggataaagatgtggggaccattcatttacaaatgttatcaaatcttgcgactgctttacttgatgatgattttaaactaaagcttcgtaatttggatgacaaaggtcaaatttcagaatttattactaaacagattggagagacaatatcatgaaaattgtaggaatttcagcttgcccagcaggattagcacacacaccaatggcagcaaaagcacttgagaaagcaggtaaagaactggggtacgatgtcaaaatcgaggaacaaggctctatgggacctgtaaatgtcatcactcaagaagaagctgacgcagccgattttgtattgattgcttctgaccaaaaaattactggaatggatagattcgaaggaaaaaaggtattacgtgtagatattaacgtatgtataaaggcccctaaagcagtcttgaaaaaatgcgtagcttcagtataggaggaatcataaaatgaaaagcgctaaaactttattagccgaatggaagggctatttaatgagcggaatttcgtacatgattcctacagtaattggtggtgcaatgattgtagggatacctcagcttattgggatggctatgggggttaacgatctttccaagtacaaaaacgcaagcaatattttccatattttatacgaaattaattctgtaggatggattggaatcggtttagtcaacttagtaattgctggatatgttgcatacgcaattggagataagccggcgttaggagctggtttcattggtggtcagttggcatcaacaattaacgcaggattcttaggagccttaattgccggatttgttgctggatatgtggcaagatggtgtcgaaaaattcaagttagtgatgcttggaaatcagcaattcctttattagtagtgccgttacttactactggagcagttgcgttagtggaaggcgtcatattatctgggccactaacttggattaatgttagtttagtcgcttgggtaaaagggatgattagcaatcatactaacggagcaattgtcgcgattgtattgggtgccatgattggaactgatttaggcggaccaattaataaagctgcttggatggtaggaaatatcttatttattgaaggaatttatggtccagctttgattactaatattgcaatttgctgtattccactcggatatgctttggctacctttatttatccaagacgtaaattttcagacgaaatgtttatggctggaagaaacaaccttattatgggaacctttgggattacggaaggtgcgattccattctttctaacaagtcctttgaaacttttaccagtcaacatgattggtggtgcgctaggatccgttacgggtgttctactaggaatgcactcccacatcccacctctaggaggactgcctggaataattacagcagataataagtttgcctacattgctggaatttttgttggagctttatttattggactagttgcaccattagtggctaacttcaacatttctagcgagaatgaaggcgaagatattagtgaagatgatattaagattgagattggttgattgcgaggtagttaagtagatatggttaagactgtacatgtgattccacatactcattgggatcgagaatggtattttacgacgtcacgttcaaaagtatatttattaaaggatctatcagaagttatagataatttagaaaataacaagggatatgatcgatttattttagatgggcaggcttcactaattgaagattatttaaaatggcgtccagatgattttaaccgagttaaacagttagttcaggataaaaagttgattatcggtccctggtatactcaaacggatcaatttgtaatttcaggtgaaagcattgttagaaatttacaacaaggtatggacatttgtaatcaatttggtaactatatgaacgtaggttatgtacccgactcatttggccaagaatccagtatgccacaaatttacaaaggatttggtattcaagataccatgttttggagaggtgtatcggatgaagaagtagagcatacggaataccaatggacaggggaagacggcagtaaaattaacgtttaccaaatcccatctggttattatattggcggtattattgatgaatcgcaattggatcaggttatgagaacggagccttttaagtcaattgtaaaacgggcgacaactaaaaatattgcttttcctaatgggtttgatcaagcaccagcaagaaaagatctaccaaaagtaattcaaaaattaaaccaagataacccagattttaaatttaaattgagctcgattgaagaatatatagaagcagtaaaaaaagagcatcctgaattagaagagatttcaggagaattaacaaacggaaaaaatatgcggatacacaaatcaatatattcttctcgttctgatttgaagaaaatgaatactgaaatccaatattatttagtgaacgttttagaaccaattttaacgatggctgaaaattgggggattagttatcctaaagaagccgtaaaagatatttggaagttaatgtttgaaaatgcagctcatgattcgattggagcatgtgtctcagatacgactaatgaagatatatatatgcgttataaacaagcaagggatattagtattaatttagttgaagttactttacgacaaattactgtacgaattaaaaataatacaaaatacccaattacgttaactgtatttaaccctcttaccgttaaacagcaacagttggtaaaaacagtagtatattcgccaactaaggatttttcactaagagatagtgaaggtaaagaaattggttatactatcgttcaatgcgaagaccaaacggaatatatcattaatcaaactatccagcttgatccgtcacgaaaaatttttaagccatctaaagtttacaaggctgtaatataccttcaaacggaatcaattccagctactggatatcaacagttatatttggactactcaaccaaagataataaaccgttaaatgatagtactgataactcactggaaaataacttctttaaaataacaattaatgaagatggcactctagatattttagataaaaaggctaaaaaggaatacttaaagcaagcaattttagaagaaaatggtgatggcggggactcatttaattactcgcctgccaaaaatgatatggtgatttactcttataaccaagagcatacagtcaacgttaaacattctgatttattatcaattgctaaaattagctacaattttaaagtacctaagaacctagaaagtcgcgctaaaaaaatctgcaacacgtttatgccaattacgttgagtatattattggagaagaattcaagagtaataaaatttaaagtgaaggtggacaattctcttccaaaggaccatcgactatgtgtgaactttgataccggtatccagtctaaagtttcaatagctgaccaacaatttggaacgattgcacgtccagtttatcggcataaagaaatggaactttggaaaaaggcaaaagaccagtggaatgaaaaacctattacgattgaaacttgccaatcattcgtagcgttatctaacacgactagtaccgtggcagtaatgcctaagggtgtacgtgaatatgaaattactggggaaaactattctaatatccgattaaccatcttccggacgtatggttggatgggaaaagaggatttattataccgtccaggtagagcttctggagagaaagtaattgcaacccccaacgccgaacttaataagcaaatggaatttgagtttgctttaaacattgaaaatgacacctttgacaatgtcaacgtcggaatgacagctaaaaaatatgatacagggttacaaatatatgaatacgctgatttcttgaatggtcgtttaatttttaatatggatgaagtaacacctttcttggacagcgaaaatggattgattcaaactaagggtaacctagtattaagcagcttaaaaaaagctaatcaccgaagcggctacattataagactgtataatgcaaaaaaaacagaatcagtggatgatgtaatcagttttggggtaaaacctaatcgagtcgaattagtagatttgaaagaagatactattgaacctttatatttggaagaaaataagtgcgatttaaaggacgttaaacatgctaaatttgtaaccgtttattttgaatactaggaaacttagtagcctattctatattaatgtatgaataggttacttttataatttgtaaaattatgcactagataaatttgatgtaggagttttaaaaagatgctagaactttcttatgcgcgtttgaaaaaaattttgatgatcttagttgttgcacaaaaggaaattagttctagttacttatctttaaagcttaaagtaagtgaaagaacaattagaacagatataaaccgacttaatgaagatattaccaaatacaacgttttaattaagcatcatcgttcaaaaggttattttctaaaagaagaacaacctggaagtcttgctaaattaaaagcagatctgaaagaacttgataagaaagtgctgtttgattcggttaatatacgtttaaaaaagttaatgtgtttattgttgctgaccaatgttccaataagcatttataaaatcttggaagatatgtatatcagtagcggtacccttgccaattatatagaagagattaaaagtgccattaaagggtatcatttagaaatcgcacgtgttaataatgctttttcaatcgttggggatgaggttgaaaaacgacaatgtttcattgatcaagttgaagataaaaattataaaacttatattttaggtttcacagatttagagaagagtattttcaaggaaattaatttagatgaactaaagagtgtcttagatgaatttatggataaattagtttttgatattgcagattttaaccgaaaaaacatcattatgcatatagctattaccattctaaggataaaaaatggcaatgaaataaccaccttctctgataattcaataattaagggaggaattgaaaaagagtttaaccaattatttgttggaattgagcagcaatttaatgttcaaatctctagtgctgagcgaaactatattaaatatcactttgctctaaataatccgcaaattattcgagatacagaagacaatagtgaagtagagattaataaagcaataatgctttttctagataggatacggaataattatggatttgatttatctgatgccacagaattaattaataatttaagagcacatattacgtcacttataaaaattaatcgttttgatagtactcggaagaatccactactagatgtaattatttccacctttcctttagcgtacgaaatgacaaaaacctcaattgatgttttggaaaaacgattgaacttaacttttaatgatgacgaagtttcctttataacgttgcatattggtgctgctatggaaaatagatataatcagagattaagcgctaaaaaagtagctatcgtatgtgggtcaggaacagctacggcaaatttattaaaggtgaaattagaagccaagttcagtcaatatatagaaattgtaggcctatactcgtttgaagagtaccgcaaaggcaaaatggaaccagtagactttattatatctacggtacctatttttgacagtaaaataccggtagttcaggttgatttagctaattttgctcatgatagtaaagagctatcaaattttattacaactactgaaaatcaaccactgtctaaattgtttgatcaaaatttgatctttattcatcaagatttaaaaagtaaagatgcggttttaaggaagatgcttagtgctttagaaaaagaaaatgtaactaagccagagtacaaacattttttaatgaagcgcgaaaaaatgtattcaacagcaattggcggaggtatagctatcccacatccaataaaattttcagcgtacaagtcaagagtggcatttttacaaactgaaagggaaattaattggggaaacgagcataatgtggatttgatttttatgttggcaattaatgaagatgattatcccaaaatacaaccactgtttagctttttggtagatttgcaggaaaacagtaagtttttgaaattaatcaagaagactaattcagcacaagaagcattgcaaattattaattcgtttgtaaaagaaagcctagattaggaatagtagaacattggattatgtcaacataaaaagcactcccaagttggagtgcttttttgaatagaaggttagtattttatttaatgggaatagctgcacaaggggtgcgtcctaatcccccaacgaaaaccgcaacttcatattgcgggaaccgaggttgattgcatcgttaagcagtttagtagcctgggctaaggtgaaatcggccattgcctggttagcggacgttaaaattttttccgtgagcacggcttggtgatccgtttctttttgcactcttagcacgttttggagtaccttttgggcaaagttttcctgtaaatcttggtagagggcaaaatttccgtccccaattaaagcaagcacccggctaatccagtacatgtagttggtattcactaccgtgggggtatcgcggtagcaagccggagtatccgcgacgttactataaaacggcaccatggcgttgaacgtgttgggaccaaaagctagccaatgaattcccgcgatttcatcgggaacttggttgcgtaactctagaatgtgagtttctagattgcgattgatgccgattggccgaaaacgtttctcgggcacagtttcgccataaggatcgtagggcgtttcttgatagtgtgaactcaaaagaaacttcaaatcttccacagaaattttcttggttgcacgattaatgaaaggtaaatcttggtcggtaggctccccaacaaaattatcgtccaaaaattggtggacgtaccaagcccgggggttattgtagtaccggtctttaatcgtggcactaccaaaaatgtgccgtaaattaaggccttcgtgatccggattaagttgatttttggcaatgaattccggtaaatccgcagaggctaggcaatcagctgaattaaagtcgaaatcggtgatgttccagcggtttggcgcaattgcataggcgtcgtcgggaattcggattgcagcccaatgatggcctccgatggtttccatataccaaatttcttcgcggtcggcaaaggcaattccgttggattcgtaagtgccgtattcttctaaaagtttacctaagcgcaagacgcccgccttggcagtctcgatatacggcaaaactagcgtaagaaaatcctcttcgccaagtcccttttcgactaacggatccacgctaagtacccgggcgttagtagtaatggtttcggtagcggtcatcgccgtgtttttactgttgatgccgccagcaccccaaatgccatacgtggaatcggcatcgggcgtggcggtgtagcggagcggattgtcaggaaggggaatcgttaaatcactatggacagaatgatagggttggggctgatcttcggggttaacgaccacgaaccgttgggcattagaatcatcggcaccgtcttcgttacgggcaatgatggtagaacccgtcaggctagcgtttttaccgactaaaatagtggtgcaagttttcaacatgtgcttgtcctccaattgatttttactgtaatggtagcacgattagctaaataggcaatcactattcagttagaaaagggaatgctatcatggtcaatatacaatttaaactaacatgaggagcgttaagcaatggttaaaacaattgcaatggaagatttttaccaaaaatatccgctaactatcgctgttttattggacgtacgggagccggacgaatttgcggctgggcacgtggtgggggcgcgtaattttcccttaagccaactacctactcgcttagctgaattagaccaagcgacccaatactacgtgatctgccgttcgggaagacgctcagcaaatgcgtgcggggtactcgaagtccagggctttgatgcaaccaacgtagccggcggaatgctagcttggccaggaaaagtggaaaaagactagataaaaataaacgcgggaaacaaaagtcgggtaatttctgagcgttaactgaaaatagaccattatgccaaattcaggcataatggtctattttcagttaagcggaacaaactaatttttggtgcacgttgggctttactaaaggcccaacacccgatttactatctaaaataccaaaccagtacttgtaaagctaaaaaagttcccgcggcaacgccccagttccatcggggaatggcgtaagtttggtagtgggtgcgcggctgattttcgctaaaaccgtgggaatgcatggcaattgccaagttatccgaccaacgcagcgatagtaaaatcgccttaaaaaagattgtgggggaccagacgtgtaaaacttcaccacgcatcatggctgcggttttaatttgttgaacggccgtctttacccgggggatgaagtaaaaggcgcctaacgatccgtaaacgaatttggtaggtaaatgccaattttgttccagggaacctagcagactttcgacggtcgcggtaaaagaaaatgccccacccaaaacaatgtaggcgtaaacccgggtagccattatccaagcggtccgcaccgcgttgccagtcccgtttaaataaaacgaaatccaagttgctacggcaggaagcagcgggattaccaaaagcaggcccagtttgcgcaccgcaattcgtttccaaagcaagtaggctaatccgccaatgataatcactaggttaacgggaacacttttaacaaaggcaatttcaaaactaattgccagaattaaaatgaatttaactgatgaatccatttagctcctcctgataaataagctggtgatcggtcaatgccaaatgatagtcaaaaaattctggcagtcccgtcaattggtgactgatcatcacaatggtttgtttttgtacttgggcagctttttgaattaattgtataaccacccttacggaagctaaatccaagccggccaaaggttcatcaagcaaaacgagcgggttgcctaaaattaacatggttaagatttggagctttttcttttgcccgcccgaaagttgataaacaatctgttcttgtaacttcgctaaattaagacgttccagccagtcctggatacggtcggcagtccaatattggggtgcccgggcattctgtaagcttaggtcgatttcttccgtgacggtcattttaagaaactgcatttcagaatcttgaaagaccaccgtagcagttttcgcccaggttcgcgcgttgaactgagaaagcggccgattatcgtaaaaaagtttgccctgatagggatgaagtcgggcaattacttcgaataacgtcgactttcccgagccgttttcaccagtaagcaaaattaagtgttgcttggggaaggacgtttggacggcctgaagtagataccggcccccgttttcaatcccaaaatcttgtaactttaggattgcagcagcgtttgcgttaggaatcgggaacgccgtgcgggtggttaactggtaacgtgcaaaaatcggttgtggatcagtaattaagctaacttgttggtgatcaagctggtataagtgatcacaaatttccgcatagtcgttgagatcgtggtcggcaattaaaatcgtcttgccttcttgtgcctgcagcttttttaaaagcttgatgagggctttgcgagattttaggtcaacgttggcaaatggctcatcaagtaaaattaagtcactgccagttgccagagtaatcgcgagggcgactttttgcagttctccgccagaaagggtggcgagttgccggtggcgcaagtgagcaatccccacttgactaagcgcttgagtaattaaatcgtcaatttcatcagcgggaatagccaagttttccaaggtgaagatgaattccttttcgacttggtccatggcaaattgttctcgtggattttgaaagagcaacgtcaatttttgggtcagctccgcgggttgccaggcggtaacgtccttttcttccagtttgacggttccttggataattgttcccgcaaagtgagggtacagtcccgcaataatccgtagcagggtagattttccaccaccagacggaccgtacaaaacgttaaaactaccagccgttaggtgaaagttaagttgtttgagaatcggctgagttgcctgccgatatttgaaagttaaattgttaattgtgactttttccataattggatgcctacttccgccgcataatgcccgaacgctctaccagccggttgatccaggcaactaaaacgccacagaagaaaccaattgaaataaaccgagcgataaacaaaacgattagaaagcttggacggtaagcggcatagccttcttgggcaaggctccagccgaaggtaatgatggtgctagtgacggtcgacaaaaataaggccagtttgtcgtaatggcggtagccagtgaaggtgaaaccaagctcgctcccaattccttgaatgagcccggaaagaattgcaccagcgccaaactgcccgcctaggagcatttcaaccagaccacccagagtttccgcgatgatactggatccaattttgcgggtgagcatgatgcctaaaggaccggcaatcatccataggccaagtaacaggtcattagctagcggaccgagaccaattgcggccaaccccgccgttagaaaactatacgataaattagtggcgaaaaaaatcaccccacaaaaaatcgcgattaacacaataaagactacgtctcgtaacgagtaattccagtttgcttttttagtattcataactaaaaaacctcctcagtaaattaataaatttacttagaaacaagaagccagaaaaatagccagcttttcggcaacgaaaaactggctgttattatccaatatctccctacgctaatactaattagaccaggttcaatgggtattatctcagccaaaacggcaccccagcattgttgtttttaagtttttactatgaagcaatcgtagcattttgtaatcggcttgtaaagcggttacttggctgcaaatggtctacctaaaaattatgggaacagattggtaaggtcacgttattcttaacgttagatatgacaagggacccaaccgaaaaaataacaggggtaataggatgatttgtgaaaatgattgcaaattggtactggtaggtttatgcttaagttgatagggaatgcgccgaataaaataggtttaggaggccaatgaaatgagtagactagacggaaaagttgcgattattactggtggagtaaaaggttttgggttagcctgtgccaaactttttgttcgagaaggtgcaaaagtggtgatcacggacgttgatgttgctggcgcaagtgaagccttgcaggaaattggcgaagataaggccgttttcgtcaaacaagacgttgcggtggaagacaattgggaacccatttttaggacggcaattgataaattcgaaaaagtggatattttggttaataatgcgggaattttagcctttgacgatgctgaaaatattgaacttgacgaatggcacaagattttgtcggttaacctggacggtatcatgttaggagtgaagtatggcattcgacacatgaaggaaaagggtggttcgattatcaacatggcttcgatagcgggcctgattgggatttctaacctgtacgcgtataacgcctcaaaaggtggggtgcgtttacttactaaatcagcagccttgtactgtgcggagaaacattatccaatccggattaattcggtacatccgggatacgcccacaccccaatggtggatgcgtatcctgaaatgcgggcggacttggagaaactacatccagttggtcgcctaggcaccgcggaagaaattgccaacatggtgttgtacctagcttccgatgaatcctccttctcgactggctccgaatttgtggtggacggcggatacacggcacaataggtttagcacgctactcaatttaataatggattaataaaactggtccaaataggaggttaagcctatttggaccagtttttttgtgaaatactagtttgaatggttatttgaagaatggaaatttgcttggcgggaacgcagggaaacgttaatctttcttgccgttaaccaccagtagaagtaaagggctaaccaaacaacaggatagataatcaagtacccccagatgaagctagctacaatactaggagcggcaaagtgccagttaaaaacaaatgaagttccggcaataattagaaaagtacccacaaagtgaagaaaaattttgcctaaaaaggggatttttaaaaattgatgactttgtagttcggtaagggtaattgttagaagaccaattagagcaaacatcaagaagagatgcaaggcgtgttggggagtcggactaattgtggtaaacccgcatgcaatggttgctaaataaaaggtcgaaccggccatcacgtggtagacaatgtaccgcaaaaacttttttatcgcgttcataattggatacctcacaatcctaaatggtgttttaagtcgggcagatattttcggctaatgattagttttaaattattttgcatgcgagcaaccatattaccggaaaaagagggttcaagtagttttagataatccaagttaagggcggcgcttcgactaattcgaacaaacttagttgcatcaagcttagcaagcacgttttttagctggccgtgtaactggtaatcctgggtaatagtgtggatcgttacttgttcgcctaagacctcaagagcaacaatttggtcacaaagaattaggttgacttggtcatcgataacaatcggcaaagtttctttttgtttatccaattgatccaacagttctaataaccttgtaactttagtatttaaatgtgcagctttaattgaaaccatgatttcgtcggtagctaacgaggtatcttggttaaacgagattttcaatttaaccccttctttccgaggatggttagatttgtttagtaataaaattccggctccgtttgctaagtaataaggataataagccgaatcctaagaaactggcaaataaaattattatcatggtcgaaccagttaatggtccatttatattaatgcgaacgcccatgtttttttcaaaaatgtgtcgagtctggacactgttaaaggtttggtttaaagggtttttcatcagcaggttacgaaataaagctgcgttataaattgcgggagtcaggttaatgaagtgttgtgctgaactaggtaacattccgcttggtaaatagactcccgcgagaaagccactcatggttccgatgatggtccctagccgtcctaaggtctcaatgcgcgtaacaaagctgagaataaattgagaaaaggcggtccaaactaagctgcttaagatgatcagtaagaataacgggactaattgttcaaaaggaaaacgcagttgatcagttatcgaaaaataagtgtacatgattgctagcataccgaattgcatcacgatgctgatggtaattgcactaattatataactaaactgaatcttaaagtaggcaaccggggtgattaaaaaatctgccaaagttttcgttccacggtcaatgatcatttgcgaaaatgccgtgagggtggtggtaatggtggtgacggttaggactcccccaatcacccaaggatcaagaagtaaattataatttttaagcataagggcgctatcaatgttatcccttaaaaagacagtgtagaggacaaacgcgattaacgcaccaaggagtgaaaaaaatatggtgcttggactgctgaagaaaaggtataagtttcgtttagttagtgaccacattttaattaacttcctttccggtgagtgcgaggaaaatatcgttcatgttgccttgccgacattcaaaagcggttagtaaggcacggtactggccaacgatctggaggatttcgtcaatactggcaacgtgtaattcaaaaccggtagcaacgtttgaaaatgaactgttatttttcaatagagcttgttgtaaagcaagacgattattcggaattaagttcagtgagtattgcgcgtactgaagctttaaattagtgacagtatcgtcagcgatgatttgtccgcgatcaattacgtatacgtaatcagcttgttccgtttcctctaagtaatgggtggttaaaatcacggtcattttggtggtctgttgaagcttatgaatggcttgccaaatggtattgcgagtctgaatgtccaatccagttgacggttcatccaagaacaaaacttccggttggtttactagagcgcgaacgatgtcgactcgccgacgctgcccgtctgaaagggtgccgtagggttgttttaaaagattatttaagtggaaatgtttaaacaagaattggagccagctcgaagaggtttgggaatacatatttgcccgacttcgaatattttgccgaacggacatttttttatccagtaggctattttgaaaaactacgccaatcttttttcggtagtcggagtctgcgggatgcaaccccgccaattcaatggaaccactggttggtgaaattaaaccaattaacatattgattgtggttgtttttccagcaccattgggtcctagaaaagcgacgaattctccagtcttaatttttaagtcaatttggtttacggcaatttggtgggaatattttttagttagatttttaacgattagtgtgttcataaagtcatctcctttggttggaattagtataaaggagctagtaaaggtttgtatggggacaagggacaagtggtttagtattcggggtaagtggttaatatggaaaaacaaactgatttttggcgcgtactttagcactaattaggttcagtaaaacaaaatattttaggtggtagtaatgagaaatcaaacaaattaaaaacctggtccgcaactaaactgcgatgaccaggtttttgattgttattttaaattacgttgtatacaccatatatagtggttaatcgttcattaagcacatatatcttgtgttttaaacctttatctttttgcgaaatcggagtaatctatgatgtgaagagaaaccaatcaagccagtttcgaatatcatacagctttaaataaacagaaaataataacgttgtttattatagcgagaattgaacgagattggaataaaaaattagaaaaggacgggtggttaaaatgatcaattcgcaagcaatcgcaaccgatgcttggactgaattacgtcaaaaacaagtagttaaagcagatggggaaaggatgcaattttatccctataaaatcgcgctagtggttgatcaattaaccacggacgatgttgaacggcaaaatattacgcaagcaattttagaacagttaacgcaaatggcgtcgccgctaacggtagaacaaattcgggcagtcttcaaagcgatcctccatgattatcaacgggacgacttgtgggaaaaatatgctgaatatcggcaagccgatgaagccaagtggcaggccgcgattgacccgcaaaataaattaagccagttatttgatggaagggatacggtagttcacgaaaatgctaataaggacagtaatattttcagcacccgtcgggacttaacggccggaatggtcggcaaatcatttggattaacgatgatgccacagaccgtagcaaaggctcacttgcgcggcgatattcattttcatgacttggactattcaccgctaacttcaatgaccaactgctgcttgattgacttcaagagtatgctagcgaatggttttaagattggaaacgcggaagtagagtcgcctaagtcgattcaaactgcaaccgcccaaatgtcgcagattattgcgaacgtggcatcgagccaatacggagggtgttcgtcagaccggacggatgaaatgttggcgccttacgcaaaattaaattacgaaaagcacttgaaggaagccgaaaaatgggtgctccccgaacaacgggaggcctttgctaaggaaaaaaccaagaaagatatttacgacgcaatgcaagcgttagagtacgaagttaacacgctgttttcatccaacggacaaacgccgtttaccacggtgggatttggtctgggaacttcgtggatcgaacgggaaattcaaaaggcaattttaaaagttcgcattaagggactcggtaagcagcaccggaccgcaattttcccgaagttggtcttttcaattaagcgcggaataaatttaaatccggaagatcccaactacgatatcaaacagttggccgtagagtgcgcaactaaacggatgtatcccgacgttttaatgtacgacaaaattgtggaattaaccggaaactttaaggcgcccatgggttgccggagcttcttacaagtttggaagaacgctgatggcgaagaagttaatagcggccgaatgaatttaggggtcgtaaccgtcaacttgccacggattgcgattgaagcccagggtgatcgggaagtcttctgggagattatggaagaccgggtggcgttggcgaaaaaagccttactcttccggattaaacgttgccgggatacccaaccacaaaatgcaccgattttgtataagcacggtgcctttggggtccgcctcaaagatggtgacgacgtggaccaactgtttaaccaccggcgggcgaccatatcgttaggttacattggattgtacgaagtgggaaccgcctttttcggtccggattgggaaggtaatcaggaagcccacgatttcacggtttcaatcgtgaagtacctgtacgaacagtgcctagcttgggaaaaagagtacggctaccatttcagcgtttactccacgccagccgaatccttgacggataccttctgtgaggatgacattgaaaaattcggcaagattcaggacattaccgacaaggaatactacactaacagtttccattacgacgtccggaaaaatccgactccgtttgaaaaacttacttttgaagaagagtacccgaagtacgcggccggcggttttattcactactgtgagtacccgaatttaaaacaaaatccggctgctttagaagcagtttggacctgggcttatgaccacgtgggttatttagggacaaacgcttcgatcgaccactgttataaatgtggtttcgatggcgactttaaacccacggcgcgtggctttgaatgcccgcaatgtgggaatcgcgaccccaaaacttgtgacgtggttaaacggacttgtggttacttaggaaacccaatgattcggccaatggttcacggacggcacaaagaaatttcatcacgggttaaaaatatggaataggggtgaaaacgtggttagacaacgacgagtacggtcaccgagaaatccccagccgcaagaatggctggcgaaggatcgcagtttagaatacattgccgactataagccgtttaacatggttgacggggaaggaattcgttgcagtttgtacgtttcgggttgtttattcaactgtccgggatgctacaacaaggcggcgcaaaatttccattatggacgcccctattcgcagaaattagaagaccaaattatcgaagacatggggcaaagttacgtacaggggctgaccttgttaggcggggaacccttcttaaacacgcaggtttgcttgcggctagtccggcgggtgcgcaaagaatttgggcacgacaaggatatttggtcgtggaccggttacacctgggacgaattgatgcaggaatcttacgataaattggaattgttaagtgaactagatattttggtggacggccggtttttagaagctaaaaaagatttgacgcttcaatttcggggaagttccaaccaacgaattatcgacgtgcctaaatcgttagccgcaaaccaagtcgtcatttgggataaattgcttcgttaaggtaggagaatttgatgagtaagttagaaattaaaaatttaaaggtcaatgcgggtgatgagcgcattttaaacggggttaatttacaaattaatccgggagaaattcacgcattgatgggacctaacgggactgggaagtcaacgctttcggaaacgattatgggaaatccgctctacgagattgtagatggccaaatttggttagacgggcaagacatcacggaaatgagcgtggacgaacgggcccgggcgggagtctttttagcgatgcagtatccgatggaggtcgcgggaatttccaacgccgacttcattcacgcagcgttaaacgcacgtaaccaaggccaaccggttgccgtactgccctttttaaaacagcttaaagcgaatatggaatttttagaaattaatccggaatatgcggaccgggggcttaacgccgatttttccggtggtgaaaaaaagcgtaacgaaatcctgcaaatgatgatgttacgacccgagatggctattttagatgaaattgattccggattagatattgacgccctcaaaattgtggcaaaggggatcaacgcaatgcgcagtaccacctttagctgcttgatggttacgcactaccagcgcctgttgaattacgtggtgcctgacgtggtgcacatcatgatggacggccggattgttaaaagcggcggccccgaactagctacggatctggaaaagactggctacgctgaattagaggaaacgttaggaagtgaaaccagccatggcgattcccttgaataaaacgacgaccgcaagttatccccgaattttaggaattcggtatgaccccgcagtttttaccttgacggattcttccagcgctacttgggactgggaggccaacacggaagctttgcaagccattaatgcagcgggaggtacggtccggcgcattaatggctcgacagcggaactatccgggctgccccaattactagcttccacgaacaaccaatttgtgcaacaacacttgcaagaccaactccaaggtgtggtaatcagtttgccggaccacgcggaaatttcgccaacgctaaacttaaccttgcgaacggagtcagcttttcctgtggaatggacggtttggtttgatttaggggaccatagtcggctgaccacgaagttaacgctagatttagcgggagaagtgccccaatccaactgtttgattgggggaactttagcggacgaaagcaatttgacactcatcactgacacgcaaagccaccaagctatccgaagtttattgctaggtgattttgtgagtgctcgggatgctaacctcgattggtccttgtggccacaaactaagggccagctgttgggtgatttaaacgtaacgcttgctggaaccggcagtcgggcaacccttaatttggcgcgttacggctaccaagatgactgggtgggcatccgtggtcaaattaagcatttgggccaacatacttttagccgaatcaacatgcggggagttttgtacgaaaattcccgggtcaactttacgagtattggccaaattgatcatggggccagtgatgcggacgcggaccaggaaagtcggttaatgaccgtagaaccgcatgctaagggcagcgttaacccggtcttagtgattgacgaaaacgacgtccgggccggtcacgctgctagtgtcggccagtatgacgaagatgaactttactacttacaaagtcggggtctgccgatggagacggcaaagcaaattttaattgataactttatggaaccgatttggcgtttgtgcaacggggaggttggctaagatgacggattaccaaggcttaacatatttagataacgcggcgaccacccccatgccagaggaagttttagcggtaattgacgagtattaccggtttaacaaggttaacgtccatcggggaatttatcagcttgcgggacgggtcaccagcgcttatgaagcggttcgcgaacaaatcgcccagtggctgcatgctcctcaaccagagtcggtcgtttttaccagcgggactaccgacgcgttaaaccaggttgccttcggctatgcacagccgcggttgcagccgggtgacgaaattatcgtcagtgtactcgaacaccattctaacctagtaccttggcaacgggtggctgcccaaactggggcacgcctgcgaatggtgggaatggattcgcaaggtaacctggattatgctcaattagcagagcttatcaatacgcataccaaggtagttacgctcacgatggtttccaacgtgttggggacggtggttgacgtggcaaaggttgcccaactagttcatcagtatgacggaatcttagtggtggacgctgcccaagcggtcgcccatttgccaattgacgttaccgccatggatgtcgattttctcgcgttctccggacataaaatgtttggtcccacggggattggggtgctctatggcaagctagctcggttagaggagatggaaccggtccgttttggtggcgaaatggtcgacttggttacgccaacttcggcaacttttcagccgttaccaatccgtttagaagcggggacccccaacgttgctggcgtactagggctaggagcggccgtgaagtatttagaaaaacaggactttgccgctactcaaaaacatgaagcacgcttaatgcagtttttacttaccgaactccaggaagtgccggaggttaaaatttacggcccgttagattatcaacaacgagtgggagtggttagctttaacgttggcaaacaccacgcccatgacgtggccacgattttagatgcttcgggagtggccgtgcgcgccggacacctgtgtgcggaaccattaatgcaagctttgaacgttagtagcgtcgtgcgggcgagctttaccttcgaaaatcagattgctgatctgcaacgcttagtggacgcggtagaacaagtggggcggattttatcatgaacaatttacaagagttataccaaaaaattattttaaatcacgctaagaacccgataggctacggaaaagtaccccacgcaaattgtgtcggggcgttgcgcaatcccgaatgtggcgacgagattacggtttatgccgaagttgacgcacaacggatccagcaactgggtttcacggggacgggctgtgtgatcagcatggcatcggcaagtatgatggttgcgcaattaaacggccgcacgttagcggatgcccaccaactctgggaaaatttccaaaatttagtgttacaaaaggattgtgattccgatcagctgggggatttagcggcttttgctagtctgcatcagtttccaacgcgagtgcggtgcggtaccttagcatggcacgcgcttgcagaaggtttaaaggagaagggagaagtttttgatggatgaagtcagtccaacgcaaccaggaaattttaaggacgaatggggaccgatggatgacgtccagccggtcttttcaaccggggtcggaattaacgaggaaaccatccaagccatttcacgggcgaagcacgagccccaatggatgctagacttgcggttacaggcctatcaaatttaccaatccatgcccatgccgagctttggaccagaccttagtgagattgatctgaacgaaattaaatatttccagcgggcaacggatcacattgctcgcaactgggaggacgtgcccgacgaaatcaagactacctttgaacgaattggggttccagaagccgaacgaaagtacttagccggttcggcggcacagtatgaatccgaagcggtttaccacaacctcaaacaggatttagaaagtcagggaatcatttttatggatactgattcagctttgaaacagcatccggaactagtccgacagtactttggtaaattgattgccgcaagcgataataagtttgccgccttgaataccgccgtttggtcgggcggaacttttctatacgtgccgaaaaatgtgcatgccgacgtgccgatccaaagctacttccggattaacgcgggtcggacgggccagtttgaacgaaccctaattatcgtcgacgaaggtggcagcgttaactacgttgagggatgcaccgcgccaaattatgcggaggatagtctgcacgccgcggttgtagaagtgttcgttaaaaaggatgcctattgtcgctatacaacgattcaaaattggtcaacgaatgtgtacagcttagaaaccaagcgggcccaggccgaagcaaatagcaccatggaatgggtcgacggcaatttaggctcaaaggtcaccatgaaataccccagcatttacctaacgggcgcgggcgccaccggctcaatgctgtcgattgcggcggcgggtgccaacatgcaccaggatactggcgccaagatgatccatttagcaccgaacacccatagcacgattgtttcaaaagcaatctgccataacggcggtcgggcggactaccggggattgattaagtacactaaggcggccaaacgggctaagtcccacgttgagtgtgatacgattttgatggatcaggacagtgccagcgatactttcccggttaacgacatcgaaacgagcgacggcacgattgaacacgaggcccacgtttcgaaaatctctgaagcccaactgtactacttgaaaagtcgaggattagacgaagcgaccgcctctcaattaatcattatgggatttttggagcccttcaccaagcaattaccaatggaatacgctgtggaattagaccggttgattaagtttcagatggagggcagtatcggataaacaaactgagccatttgttcagatcaaattatgagaggaatgctgacaattatggatgataatattaaaagcttaaacgaagcctttattaaggctacaactgaagtgactgtagatagaatttcaggtaaaattaggcaaattaagacgaatcatgacttaagaaagcaaataacagagtatgatcaattgataaatgatttattaggtaataaaaatgatctggaacgcatatctagagaatataagtcaaggttggaaagagtagttataagtgatgaagatattgaaagtttgcataatactgtggttaatgtaatacaagtagttaaggatttttcagacaaggaaaatgatgaaagtagtgaaaattctttagatactttagttaatttgttgaatgcagacacgttaagaactcttcaattattaggttataattataaaaaagctattggagagcctttaacaaaaattacagctgactatatcagtaattttggtgaggcttataataaaaaataatgtatttaaaattttgtgaatttgtttaagataaaagtattaaaacgtacttacgtaatactaaatgttgcttgtcaacaacaatacacgctttattgggttatcttaataaaccaaaaaagaatgaacataattaggttcattcttttttacttataaactagtattgaaaaaatgcgttgaccctttgtattgttttttatcttaaagatggaaggcggcttgcacacccacgatcagcattttgacgccgatggttgctaaaatcagccccattaacttggtgatcacgttcatgatgttgttgccgagcttgtccatgatttgttcaccgtagataaaaatgaagtaggcaatgattgctaaaacaacgaacgcggccacgacgatgaaggggttggttccactagccaagttcatggtggtggcaatggttccggggccggccaaaattggcatggctagcggggaaatcgcgacgttggtgttactactgttgacggaatccttaacggatttttcaggatcgtgctggatcggcgaaacgttaccttgaatcatgtggtaaccaatcaaccccaaaatgattccgcccatgatgcggagtgcagcaaggttgatgccaaaaatggtgaagatgtaatttccgagaaaggcaaacaacaccacgatgacggttgccacgataaaagccagccgggcaatcgcgttgatttccttgcggctgttatcagcagtcaaactgacgaacattggcaagttagcaaagggattcataattgcaaaaaatgcggtgaatgaaagtaaaaatgcttgaactaaatgcatggtcgtcctccttgttaaacgttttcaatgcaatgattgttttttaattatatgggttaggtggggaaatgccaagtttggtgatttttggttaagcggaaccaactgacttttgatacacgttttggctctattgaagtcaaaacgccaaaataaaaacgattcatgaggaagtttcacttcatggaccgttttttatttagagccttttgtcacagcccttttatttattgataaggacgataatgagaatgtttgctttcaaattccttgattttggcaatttgtaaatctttaaaggtgattaaggaaacaccgtcaaacttgaaattctttccatgatcaacgcaagcaaacacccattctacgatataagtagcgccatcatgatagatatttttaatgtcccagcaagtcacggtttgtaccttgaatttatgagttatccaccgctgaatctcttgaatgccaacgtactccgctccatagcattccacgtaatgcacagctggagtgaaaatttgtgctaaatcaattagctttttatttttccacatgttgaagtaacgttggatgagttcaatttgctggttcatgagtgtgctccttattttgattggttaaagttggtgactcatttgatgagtgatggttattgtttatatacaactgatttcacctcattttaacactatgaaatagttaacttggttataaaaataatcgtttattttgaaattgtctaattgacaccagaaataatttacttataaggataaaatacgtatgataagggcgatggaaggagtcggttgtgctaaaaagcgggcaatcaaatggtaaaccttaagtgattcattagcacatccaatgtgtactcgtaaaaagaaagttaatttacccagtaattataagtggataggatataacgatgatggtcattattatgtagtcacttctcctaatataaagggatggtaactcagggaggtccactcgaagacgcggtttactgggcggaagatgctatggaaccatgttagatggcgagaaatcctatcctaaggtccaagatccaagtgattggaagttaaataaaaatgatcggttagtttacattaccgttgatatgagcaaatggctaaaaaaagaattctaaaaccgttaaaaagacgattaccgttcctgaatacttgaacgaaatggctaaagaacagaatattaacgtatcgcgggttgctagcgaagcgttgaaaagggaactgggaatctaatcatagaattagatttttactatgaaatccattccctaacccaccacaccccaatcaaaattatgctatgctagatgcaacattttttagggaggcagaattttgcgagttaatcaacatcaagaatggctagttaatttttatcaaaaacggaattggtatcagctttccccgtttgtgcgccttaattttttaactgaagaagtgggggagttgtcacgagcaattcgggccatcaaaattggccgggaccatcctggagaaccgcaacccaacgcggagcagttgcgcgacaaccttacggaagaacttgccgacgttttggaccaactattaattattagtagtaaatttgatatcgccccagaaacgttgcttaaatatagtgaggataaattgaaggcgcggtttaaggatgcgctggatgaagaataggatgataataaaaaagttctaaccgcttggcgattagaacttttttatttggaaactaaactgagctccaacttcgaataatattatttttcaaggaattccataaacaatttttgatagatttcaatgaaatcaaagtacatctttttaggtaaactttcatttacttgatgttgtgagccgtcaccagggccgtataccgcaaaaggaaaatcgtttggtttaccctttgctaagttagaagcatcagtaatccccgggctagcagccacgacaatctcacgtccagcgtattccttaccgattgattgaatagttttaactaattggtttgaaggactcgtcgcaatcgggaactcattcataattatttccgtgctaatttgtgcaccggcgtcattataagttctaaccaatgtttcaatcttcttagctacttggtcattatcatattctggaatggtccgaacattgattaaggccgtagctgaatcagggatggaattaatctgatttccaccatttaaaacatcaatgttgaatcttaccgggcccatttctccagcagggattgtttcaaaatattcgttagcttcatttagtagttgcatcaaaggaactagggcgttatatcccttttcaggtgtcgaactatgcacagaagtacccttagaagtaaatttaatatcaaaagaacccttttgttcggaagtagtgccgtaagttgaggaaggttcggcgatcagcaaaccgtccgcgtcttccatatagtggtcacggtaaaaggctgcggaaccttcttcaccaacttcttctccggcagttgcaagcaagcggatggtgccttttttaggtaagccttgttttttcaattcaatcatggcgattactaaagccgctaaaccagccttcatatccgtaattcctctaccaaagagcttgccatctttttcagtcatggtaaatggatcgctatcccacgctgttaaatttccgggatcgacaacgtccatgtgccccgaaacggcgaggacgggagcaccactaccgatttcagcaactaaattagcacgttggcccttaatcgggagaatctctaagtgaatatcatttttctggaataaatcttttagatattccgcgacctctaattcgtggtcattaacggacttgattttaattaaatcggctaaaatttttaaatattcttgattttctgaaagcatatttttatcacacctttccctttattactggaaaagattactactttctaatgtaaaaatctacttttaaaaatacgacaaatatgtccaaaaattattggtgcgggctggaggagcaatgctaaatgatattttctaaaacagaccgctacggaacgccgattgcgttctttggaagattgtttaacggagaacatagcgtattcgtaggccaaacttgaagaatttttagaagctcaaactaactcttctaaaggttgagtaacgagttttttataaatcggaaatgaggaaaatgagcattttttatacaacttactttttacaagaggtacaatgtaaaacatacctaaaaaaataagttacactcgctgaggaggaatgacgatgaaagcaattacgattagagaatacggggacgttaaccaacttcacgaagaggaattagcgattccgcaaattgcggacgacgaagttttagttaagatcaagaatactagcattaacccaattgactggaaagcgcgtatggggcttttgaagcaaatgtacgattggcaatttccagtggttttgggatgggacctttcgggcgtgattaccaaagttggtaaggacgttaaggattttaaagtcggcgacgaagtattcgcccgtcctgacatttatgaagacggaacgaagggaacctacgcagaatacgcggcggttaaggaagataaactagcgttgaaaccagctaacgtttcgtttgaagaagcagcggcaattccgttggcggggttaaccgcatggcaggtaatcgtagaccgtttaaaggtgcaaaagggcgacaaagttttaattcaagccggagccggcggcgtgggtatttttgcgatccaaattgccaaacatttaggtgcttacgtggccactactgccagtgctaaaaacacagaatttttgaagggcttaggggctgatgaagtgatcgattaccatgagcacaagatcgaagacgtccttcaggattacgacgccgtttttgacacaatcgatgctttggatgagggcttagcaatcttgaaaccaactggtaagttagtgacgattgcgggacatcctactcaacagcaacaagaagcgcagccttcagcaacggcctggtggctccaacccaatggcaaacagttagccgaactaggtgatttagtggcaaagggtgaagttaaggtgatcattgatagcacgttcccgcttacagaagatggtctccaagcggcacacgaacgtagccaaacgaaccatgcgcgggggaagattgttattaacgtgggataataagtggaaagttcatgagttccgcgtaaccaaaaattgcccattatgcccaattcaggcatgatgggcaattttcagttaatgctcgcaaactacccgacttttgtcccacgctcttttttacactcatttgcgttataatacaggaaaatagttaataacaaaggagaaccgtcatgaaagcaaccgtatttatggaaccaggcaaagtggaagtccaagaaattgaaaagccaactttgaagaagccaactgacgccgtaatcaaagtacttagagcgtgtgtttgtggctcagatctatggttttttagagggatttcggaacacgaccatggttcggcagtaggccacgaagcaattgggattgtggaagaagtgggtagcgacgtacataacgtttcggtgggagactttgttatcgtcccgtttacgcacgggtgtgggcactgtcccgcatgcttagctggttttgatggtgattgttataatcgcgaaccaggtaataacgcctaccagtgtgaatacgttcgttatgccaacgctaactggggcctggtgaagattccgggtcaaccagccgattattctgacgaaatgttgaataacttcttaaccctgtctgacgttatggccacgggctaccacgcggccttcgctgccgaagtgaaacctggagatacggtggtggttatgggagacggtgccgttggattgtgcggggtgatttcggcaaaattgcgcggagcaaaacgcatcatcgcaatgagccggcacgctgatcgacaaaagttagcccttgaatttggcgcgactgatattgttgaagaacggggcgacgaagccgtagctaaagtaatggaaatcactgacaaccacggagcggacgccgttttagaatgtgtgggtactgaacagtcggtagataccgccactaaagttggccgtcctggcgcaattgtgggccgggttgggattccgcaaaatcctaaaatggataccaacgcgttgtttagacgtaatatcggtttgcgaggcgggattgcggcagttactacgcacgatcgcaacggactactacaagcagttttggacggtaaaatcaatcctggcaaggtatttacccaacgcttcaagctagatgatgttcaagctgcctatgaagctatggaccaacgtaaagcgattaaatcattgttgattgtaagtgaataaagcgcaaccgaacgcgttaaaattatgatattaactagaaatcggcagttatctcctgaatagggacagctgctgatttttaaatgagggagatcaactagccttgagagcacgttttgccactcttataagtgtcttaactaacttttaacaatgtgttgacagttggatgaaggaagaactatattgtagctgtatggaaacgatttcaaaaaacaaggaggtattcattatggctaaagcttttgcttcaccatcttcttatgtgcagggtaaaggagtgctttttaagagtgatatttatttaagtaaatttggaaagaagcccttattaattactgatgattatgtctatgagttagttgggagtcaatttcatgactatctaaaatcaaacggttatgaagttacattagttaaatttggtggggaatcatccaatagcgaaattacccgtattacagagataggtgagaatagtaaagtaagcgtagtttatggattgggtggtggaaagactagtgatactgctaaggccgtttcagacaatttaaaaatacctgtagtaattattcctaccgttgcttcaacagacgcgccgtgctcgcgactgtcagtcatttatactgatgacggtcaatttgataaatatcgtttctatggccataatcccaacttagttttaatggatagtcaaattatagctaatgctccagtacgattattagtttcggggattgctgatgcattagcaaccaatgtggaggctcaagcggtcgcccaagctggagcggatacgatgttaaatgaaaaacaaacattagtaggaaatgctattgccgaaaaatgcgaagaaacattatttaattatggcaaaatagctgttgcggatgtcgaacaacatttggtaactaaagctttagataaaattatagaagctaacactttaatgagtgggctaggtttcgaaagcgggggttatcaggagctcatgctatccatgatggattaactacaattgagggaacccatgatttaactcatggcgaaaaagtagcgtatgggattttaacgcaactaatgttagcgggggtcgaagaaggggtttaccgtaaatattacaaattcattttatctttaggtctcccaacaacctttgcagatatgaatatagctaaagtctcagaagaagaacttttgatggctgctaaagcagcttgttctgagaatgatacgattgatcgtttaccatttgaggtagaagaagatgatgtagttcaggccttaaaagcagttaatgcgtatacaattcatgaccaagggcaataaataataaaaaatcacgaaactaagcttcactaaatgcctttcaagctctaaactggagaaaatattctccacttttaaacaaattcccaccaatcaaaaaagcaagaacgctgatatcatcctaatcagcattcttgctttttctatcttatggagtcggcgggagtcgaacctgactgctcacaaacgttgatataccaatgttttacatagctaattcaaaaattggctaagcttttggctatgttttataaaaaaatatgcttgcgaggccacaatttaattgggtctagaatttttggtgttggaaaatatttccattccaaaagtactaggccctttttgataacaaaaaaggcatctaagcctccctagtgctatgctttaagcgacgaaactcaagataagcggggtaggaatagatgtctcaactagataatacacttaaattactgcttttgatttatcttcattgtaaataggttgcataccactgttgatatcaatgatactcaatcgacgaaatcctagcgccgtatcctcattaactaattcccccgaactatttgggccacgatgtttgatcgtatccatcatagcttctataactggctttttgtcagcaatcttcttgtctacgaaaccgacgataccgcacatattaattctccttaaatttcaaaacttacgaatcttgttgctgcaccatatccaaatatttggagcaacattttgtcgggattgatattaatgaaatatccagctaattcggaaatctcattatatcggcgatcccattttttattataatcagtcgttaggccatgttttttacccattaaggccgaacaatttaatattatatgactaatcccattaactttgtagcacttttcataatgcatgtgtccacaaatataattcgatatggtcgaaataccggtatcagtaaagttatagcgaacattaactccaaaatcaccggataattcatttctaagttgtccagaatccttattattaaagctagtaaaaatcttctgaactaagtcaccgttgaagttcaaagctgaacgaccactttgactgatcaaattagcatgaccaaaagctacgacatgcttatcaattgtcttttctaaaatagatattaaatcttcgatctgttgctcgcggacaccacggacttttttgaagtcgtacttcttggtcccaccatttaggatatagggaatatcgctcgtattcaagaaaattactcgaatatcccctttatcgatccaagcaactttggaaccgagactcaagcgtttgatctcaggttgttcgaaatcatgtttcgttaccaaattatagtagtcgtcacgtctaaatgaggctgaagtaataaatttgtgttcatcatacttatcattttcatcgtgattaccttccagcacataaaaaggacgctggctattttggtaattttccatcgtgaattgtaacaatcctcgactgatctctggcttatcactaccgtcgatcaaatcgcctaaatgaatattgtaatccactggcaatgaatcgcaagccttattggcttcaataatatgccttacaccgttgagaccatagtacgatgaactggcaacagctttttcatgagtgtccgttaaaaccgataaagtcaagcaattttggctaacgttaggttcaacgttcttcctgaaaacttgctcgatatattctgtaaaaaacggtctcggctttaactttctcaaaaagttatcagtttgaacagagataaattcagatagtctcagtctaaaaaatcttttagtaagatatatattgaatttatatttaaaactaaaaaagaaaaccaattcgtaaatgaattgattttcttcaattgccttcagcaacacttgttgacttagagcccttaaaattcaacattaacgcaccaaatagggaccagagatttttaatctctagcccctattttttagtggataatcggattaggaggattaccacttttaaggtactttaaatggttagcaataaaataagttttgaaaaagctagtggttaagttggtaaccaacctgactgagcttatccgcgaaccttctagagttagcggttagctctaaatcaactactaaactaatcgaagaatcccctcatttttcaaaaattagttagttgctaatccgctaaactcgcttagaaaaatgaagctggaaaaaactagaaaaatacttttcaaggatgaaaaggtcctcaaaaagttgttttggtgttttgacttcaatagagccaaaatgtgtgccaaaagtcagtttgttccgctcaaccaaaaatagggactagagaaaaatttctccggtccctatttggtgcgttaatcgcgctaccgattactcatacatacctatagtaatattaattccacttcttttacgttaacgatgatcccgtttcttttgttcttccattattttttggttctgtcgttcaccgtctttaattttttgctggtatttacgcctgccccaatacgctttaataataaagggaatttgaataatcccgtagattatcaaagcgataattataattcttatcatcaaattcactccctgctttgccacgtattttatttaccttgattatccaccatcttactatttttccttaagaaagtcgtcttttaaaaacttccgttaaaaatcacttaccttcccaaaactcgtttgccagtgacccactaaaagcgctaaaatagcgtctgtagattctacaggaagaagggattccattggaaaaagcagctttaattttagaaggcggcgcactgcggtcatttttcaccagtgcggtattagattatttcattgatcaagagatggaattcgagtatattcacggcgtttcagccggcacgatgtgtgcaatgaattatatttccaagcaaaagggacgctctaaagacgttaatttacatttcttacatgacaaacgttacattggtttcaataatttagtccgtaatggtggtattttcaacctggacttcctattttctccagaatgttatgcttacagtccgtttgattacatggcttacaaagatagccagcaaatttttgaaattaccgcaactaacctgttgactgggaaggctgacgttttccgaaaaaccgatactgaaggccaggaagaagccatcaaagcttccgctagcatgccgctgctatccagcatccgggttgttaatcaccaaccatacctagatggtggaattgcggattcaattcctttcaaacgtgctcaagaactgggctacgagaaactagtcatcgttttaacgcgcgacatcacctaccgaaaagccgagaatagccgagcaatgaaccggctagtgcggatgaagtatcgggactttcctcaatttgtttctgcttttgaaagccgtccgcggcgttacaacgaaagccttgaggaaattgaacgtttagaacgggaaggaaaagcctttgtaattcggccccaacaaccggtcaccgtttcccgcgtagaacgggacaacaataagctcatggatctataccatcaaggaacggcagtaatcgaaagtcaaatggctgatttacgcgcattcttgaaaaattaaacctcataaattaaaaagatcgctaaccccgagggctggcggtcttttttagctataaaaagcggataattcgatattttggtcgtaattaccaaagccttccccaaaaatagtacagcctcctgacttcttggcatcgggcttaatttcaaaacgaatcgtccaaacgtctttattaacgggcaaatccgctaagcagacttccgtgaacggttgcccatctaaataagtgccgtggtcggtaattcgcaacgtctttagaattccatattggttaacgttatccggaacccagtccggagtgtacttcccacgaacatcagaaaagtcgcctggtgaacgccacgttccaatttccttgccattaatggaaaaggtgatatctgatggccaagtattgttggaaaacggaaattccgatcccagttccatagataaatcaagcatttccaagtgttcatcaatattgataaagttgggagtctgatattccacgtaaccgtcgttaaaccaaatcatcccggcgttcatccgctcgggcagcataaagtacttagggttatcgacgttgccgatgtacccgtctggacccgccaacccgcaggatggttttacactaaattcagtgtagtgcccaatcggaattccagttttgtggacgctaaacgtcggataaatttgccgcggaaacttaatatcaattgtatccactcgtaaggaagaaaccttttggtgcccctgccgtttactatgaataatttctgcttccgccagtttattcaagtgcttagtgacgattgggctactcaaatttaacgcttcggctaattcttgaacactcatcggttgatccgacagcaaacgaataatttgaagtcgtaccgaacttgccagtgcttcataaacttttaacgatgcatccgagatatctaattgcatatgtcctccattatcaaaccgtttacatttccttttcaattaattatatgccaataaaaaaccggttacaagcgcttaatttaataataaagttaacgcaaagagatttttttgcagattcctttcaaagattaacaaaaatggttgacaacgctttcaagcggtcatatattgctcgtgtaataaatgcttcacgaacctttcgaaagtttccacaccatttttttacaattcattttcataaaaggagtatctcactatgatatccgcaactgattacgttaatccgctcattgtacaacgggcggatccctatatttataagcacaccgatggttattactactttactgcttcggttccagcctataatctgattgaaattcggagcgcaaaaaccttgaatggactagcccatgcggctccccgtacgatttggcgtaaacatcccgatggtagcggtccaatgagccagctcatatgggctcccgaattacattacatcgatggaaaatggttcatttactttgctgctgcccacactaaagaattcgaccacaacggcatgtttcaacaccggatgtattgcttagaatgcgataatcctaaccccatgcgcggcgaaagtgattgggttgaacgcggtcaggtaaaaacgccgctagataccttcgccctcgacgccaccgtttttaaggcgcacgaccgtctttactacgtttgggcgcagaaggatccggccatcaaaggaaattccaacatttacatcgctgaaatggaaaatccgtggacccttaagggtgaaccagtaatgttaaccaagcctgaatacgattgggaaactaaaattttctgggttaacgaaggtcccgcaatcttgcaccgtaacggtaagtacttcttaacctactcggcaagtgctactgacgaaaattatgccatgggaatgctaactatcgacgaagacgccgatttattagacgcccgtaattgggctaagtcgcctactccagttttccaaagcaatttggccattcaacaatacggtccgggacacaattccttcaccgtggccgaagacggtaaaactgatttattagtttaccattgtcgtaactataccgacatcaagggcgatccgctttatgatcccaatcgtcacaccacggttcaaccatttggctggacggcggacggtcgtcctgattttggcaaacccgtaccttataactatgaataggggtgtacaacatgaacaatactaaaccacaatctaaacatttctgggggtttcccctcacgcattttagttacttcttcatctgggcaatcattaacggatatctcaccctctggatggaacaagtcgctcatttaaacggtaccgaatcaggagccgttttctccatgatggctggaatttcgttaattttccaaccgattttcggggtggtttcggataagctattattaaaaaagaccttaattttaaccatctcgatcgtcgatatttttatcggcccttatttccagtgggttttcatgccgattttacacattaacgccttcctcgtggcttttgtaaccgggacttttctcagcttcgtactcaatggcggggtttccgtaatcgaacagtacgttcaacgggcaagtttggcaaacggctttgaatacgcccactcccgcgttggaggctccgttgcgggagttgctgcttcactaattgccggtcccatctttctctggtctccaaactccatcttttgggcttgtacggtagccgcaattatcctaaccggattgctactcttcagtgataaaatcgatctcgaaaatgcccaagctgctggcgacacatccaactcattgaatttaaaaaccgttatgtcggtctttaaattgaaaaacttatggatcctcgcgattttttacatgggtgcttcagcactttatgacgtttttgatcaacaattcatcatcttcttcaaaatgttcttccataccgctgctcaaggaactttagtttatagctacatgacttcagctcaaattgcgattgaattttgcctgatgttcccgatgccttggatcattaataagattggttctcggaacggcttaattatttacgggtttattactgcccttcggattttaggttctgcacttgcgccaaactggatctggctggttggattccgcttattagccggtttggaaatgccattgttactaacttcaatcatgaagtatattgctggagcgtttgacattcgcctttatgcaaccgtttacgcgcttgcttctaactttgccaaacaagtttccgtcttcattttctcttcggttgcgggaaaaatgtacgacgtgattggctaccaacacacttacctaatcatgggactattcgtttttgccatcaccctgtttgctaccttcacccttaaaaaggaagatccggttcaagctggtgaagtagacgctaagaatcccgattaaccctcatataaaatttaattaaaaaaccgtaattaacctgcttttcaagctagttaattacggttttgtgtgtaaaaagaggctggaaaaaatacttttccaggatgaaaaggtccttaaaaagttgttttggtgttttgacttcgatagcgccaaagtcagttcattccgcgtaacctaaaattgaccgtcatgcccaattcaggcataatggtcaattttcagttaatgctcgcaaactaccctacttttgttccactctctttttgttagctatttgttattaaataaattcaaacacaactacttaataattttatgcactagttgaatcggttgagcatccgtgccgatttcaatgttgttatatagtagctccttaatgttggctacgtccgtcgtattgctatgaatggtcaacaagctttcaccttccgcaacggcgccgccaacttttttgtgtaattcaattcccactgcgtaatcaatcacgtcagttttggcctgacgaccaccaccaagtaacatggccgcaatcccaatttcgtcagccgtcattttcgttacgtaacctgcttggggtgcgggaagttcaaaatgatattttgcctggggcattaacgtcggatcttcgataacccgcggatcgcctccttgggcaatgatcatctgccggaatacttctaaagcgctcccgtttgcaacaacttcttcaagcttagtccgggcttctgccaacgtggccgcctttttggcaagtaccaccatttgactacctaacgtcattactaattccgtgatgtcttcggggccttcacctttaaggattgcaatcgactcttgaatttctagggcattgcccaccatgttaccaaggggttgattcatatctgaaattagcgccatgcagttcatgccaacactcttaccaattttcactaaggcattcgctagtttgacggcgtccgcctcttccttcatgaaggcgccagtcccggtttttacgtctaaaactaaagcatccgtccccgaagcgatcttcttactcataatcgaaccggcaattagcgggattgagtcgaccgtgtcggtaacgtcgcgcaacgcataaatttttttatctgctggagcaacgttgccggttgcaccaacgatggcgactttaatgtcacgaacctgttttttaaactctgcttccgagcgttccacctcaaaacctggaatcgcttccaatttatctaaagttccaccagtatggccaagtccgcgacctgaaatcatcggtaccggaattcctaacgcggcaaccatcggagctaacgggatgctagttttatctcccacgccaccggtggaatgcttatccaccttaattcccggaatgtcggagaggtccaaccggtcacccgaattcaacatttgcatggttaaattagcctgttcttcgtcagtcattccgttaaagtaaatggccatcaatagtgcacttgcttggtagtctggaatttctccatttgtataaccttctatgaaagcactgatttcctctttggttaaagcgcttccatttcgcttgtggtcgatcacgtcaaccattctcatcacaagtcctccttcaaattaattattcgtcaaccaatcgttgggcggttgctacgtcggtaattaaacagttcgcgtattgtccagctaacgcgcccttgattgcttcatacttccattttccaccggccactagcaccgcgcgttctttgttacgcaattcggctaggtcaattccaacggtgcgattattcacttcaggaaccgcgatttgaccatcttggtcataaaaccgggagcagatgtcgcctaccgccgttttttggatacgcgcgatgtcgctttggtcaaaatagcccgtttgaaatagcaacgcatcgtcccggatggtcccagcagtaaaaattgcgatatttgcctctttacctaaattaattaatcgcttgatgtagcggtcctgcatcaccacatcatgggtggtttgattttcaaaaacgactggtaaaggaaattcgtgtggggtggtgtgaaaagcattgccaaatttcatcaagacttcctcgtcaaaaactggcgtaggtgaataggtaacgctacccttcagctccaccacttgaacgccttcgacgggctgaggcgtcaacgccttcgccacttcgtttaaagtctttccccaactaaccccgattaagtcgccatccttaaccactttggctaagtacttagccgtatacattccgagctgttgggtcacgttttgataattttcatattcagcgtataccacgtgagcctcgtttagctgatacttttcgcacaacattttttctaactcttgggtactggaaaagggatcgacaattttaatctgcacaatgccgttgtcttgagcaaactgaagcagtcgggaaactgtcggccgggaaagtcccagctgtttggcgatttctacttggcccatcccggcttcgtaatgcatccgggcaacttccaagctttttttaatttttgttttatcagtcatcctgctcatggcaaccttctcctaaaccaaaattgagttaaaacctagttgggctaagaataacaatcccaacacgtacataatcgggtgaacttcactctgcttacccatcgctaatttcaaaattgggtaggccacaaagccaaacgctaaccccgtcgaaattgaaccagtcaaggggatcagcacaataattaagaacgccgggaaccaatcggtaaaatccgcaaagttaatggtggccaactgttccatcattaccgctcccgtaatgatgattactggcgcgattgctgcttgaggcacgtagcttaacaatggaataaagaacagcgaaagcaagaataaaattcccgaaacaagggatacgatcccggtccgtccgccactttcaattcccgaagcactttcggcagccgcaaccgttggactcgtacccaagaaacctgaaataaaggtcgtcaccgaactcgcttgaaatgccttccgaaattgcgatgggtcctgtaaaattccttccagaatccccatcgattcaaagactaagatcatcgtcatcgaaaatacggccaataaaaatttgatggaaaacatttggctgaaatcgcccttaaaaaggatttctgaatatttcggcagttgacttaaactaatagaagttgcctgcgtaccaccgatgtggaaaaggacgcccactagactagttacgataatcccaattacaaatccaccgggaacccggcgcaaaaagaggattagggagagtaagagaccgaacagcgctaataacgtcgccggattgcttaaagaaccggctgccaatagtgctcgttttccgccagattggatcaattccgctttttccaaccctaaggtcaccaaaaacaacccaattcctaccgtaatcccttttttcagcacggcgggaatcgcgttagccagaaactcactcgctctggtaaacgcaattaccatgtaaatcaaactactaaaaatcgaaatggcgacggcttgttgccaggatagatgcattccaactaccaccgtataggtgaaaaatgcatttactcccatccccggagtaagaattaccggtgctttcgcccacaacgccataattaaacagccaattgccgaagaaaaaacggtggcaaatacactaagtcctgctggaattcccgcatcgcttaaaatcattggattaacaatgatgatgtaggagattgcaaaaaaactagtaattcctgctaaaatttcggtttttaatcttgttttacttattcccatcaaaatttgattttcctttaccaacaatatttttttaccaaacaaagagtccgaccgttgctgccgaaactaaggataccaaaattcccgataggagcaggtaacccacgtttttagcaaccacgtcgtttttctgccggttaactaagcctttgaaacatccgataatcatccccacggttgaaaaattagcaaacgaggtcaaaaataccgttaacactgctttataatggggcgcaaattggttaatcgtgcccgtcaccttgcccattacgacaaactcgttggtaactaacttagttcccatgtattgcgcaaattcgaaggcatcgtggacgtttagcccggttaaccacgcaaacgggaacatcacgattcccaaaatgtgctctagggtaagccaaggattaatgattcctagtagtttatccactaacgctgctaaggcaacgaacgcgattacgttggcggtaatgattaacaccagtttacccgcgtttaagattgaatcacccagaaacgagaaaaatggttcccgcgttggcacttcatcttcagctaccgtcgcttcggccagcgtttccgaacccgaacccacgtcttgtgcactcgctgaacttccggaacccgccattgtggcaatcgtatcctcttcaggcgttaccgtgaccggattcaacatgttcgtgatgataattgcgttaattacgttaatcggaatcgccgtgaggatgaactgtccgggcattaaactcgtataggcaccgataatcgaagccgttacgcaactcattgacatcattgccaaggttaggttgcgttccgccttcatttgttggagttgcagggaggaaaccgcgagtgcctccgtatttcccagaaacatcatctccaccgcaaagaacgactcgaatttcggctgtccggttaatttagacaatccgcgaccaatccacttaatgatccacggtaaaattcccacgtacgttaaaatatcgaacagcgggatgatcatcaaaatcggtaataacgaactggtcacgaagttcattgacttcacgtccacccaatcggcaagcgcaaaggcgatcccttgataagcaacttggactaattggttaaatcctgccgaagctcccgcaacaatgctgcggccaatcgggaaactggttaaaaaccacgctaaaacgaggttaaataccaccatgataccgaccgatttccacttgatttgctgccggtttttggaaaaaagtactcctaaactcaggaaaaccactaatccaataatgttaacgattaaatacattaaattccgctccttagctaattgccgtttctaacgcaactttgatcatgtcatcaaacgatttttcccgttcttccgcggtagtttcttcgccagtgatgatatggttactgatggtcaatactgcaagcgcgcgtacgccatacttcgctgctaataagtacaacgcggccgcttccatttctgcacccttgacgccgtattgaactagtttttgacggtcaatttcgtcgttgtaaaaacggtcttcagacaaaacgttgcctacttgcactgaaatttggttagcttgcgcaacttggtgcgccttttcaaccattgtaaagtctgctaacggagcgtaataaatatcccgaccaaacgtatttctaataatggaagaatccgtacttgctccttgggcaatgaggacgtcccgaacgtgaatatcagggctcattccaccacaggttcccacacgaatcaaggttttaaccccgtattcgttaattaattcatttgtataaatggagattgatggaatgcccatgccagttgcttgaacggatacccgtttacctttatacgtaccggtatatccaaaagcgtttcgaatggtattataacattccgcattctctaagaaagtttcggcaatgtattttgctcgaagtgggtcccctggtagtaaaacggtatccgcaatttcgcctttttgtgccgcaatgtgtgtactcatggtatttcctccttattgcaattcgcttaagaaactagttccaacttcgttaccagcaacgttaaagttgtccaaaatggttgcccctaaatcagcgtaagtatcccgcacacccagtgatttaccttcggcaacgctaggagtgtagaccaatagtgggacgtattcccgggtgtgatccgtccccttaaatccgggatcatttccgtgatccgccgtaataaccagcaggtcgtcatcctttaggagtggcaatagttcacccagttgttggtcaaattccatcaaggcctttccatatccttcaggattccgtcggtgaccatacatggcgtcaaaatcaactaggttggtaaaactaaatccggtaaagtccttttgggcgttttcaatcgtccgcaccattccgtcgtggttactttccgtgtgaaccccatccgtaatcccttggcctgaaaaaatgtcattaattttaccaaccgctaaaacggagaacccggctgttttgagtcgatccatgtccgtttcactagttggcgctaaagtataatcgtggcgatccgaagttcgtttgaaattgtccttattcgtcccaacgtacgggcgggcaatgatgcggccaatccggtaaggtttatcaatggtaattgagcgcgcgtattcacaaattttgtacaactcttctagcggaattaccgcagtattagccgcaatttgcaaaactgaatcaccagaggtataaacgatcaacgctcccgtctttagctgttcttctccgtaatcatggataacttcggtccccgagtacggtttgtttacaattaccgagcgaccgctaaacttagcgattttatcaattaattcctgcggaaagccgttagggaaaaagcctaggggttctttaaccggcacccccatcatttcccaatgaccgtccatactatcttttccaacagagacttcgtgcattttaccgaagaacctttgcggatggtccgccaccggaactccttcaattgggtgatcaggtcggatattgcttaaacctaatttttgtaaattaggaacttggaagttgcccttccaaaactcaccgatgtgtcctaaagtatctgcaccaacatcgtcaaaatcagcggcatcactagcttcaccgatgccgaccgaatccgtgacaattgtaaaaactcgtttgaacttcatttaaacccctcctaaaactaaactgcctcactttatttttagctattcataatcttgacgccggaacttgctcctaaacgagttgccccggcttcgatcatggcttcagcttctgccttagtgtgaattccgccggatgcctttacgcctaaccggtcgccaaccgtttgcttcattaatttcacgtccgctaccttcgcaccagccgttgaaaaacctgtcgaagtttttacgaaatcggcccccgctttttcggaaagttcacaagcccgaaccttttcttcgtcagttaataaagcggtttcaataatgaccttaacgtgccggttttcagcatgcccagcttcgactacggctttaatatcattgagaaccgcgtcgtcatggccagctttaagttcaccgatattaattaccatgtctaattccgtagcgccattttgcaacgcatcctttgcttcaaacaccttggttgccgtggtatttgctccaagaggaaaaccaattacggtaaccgtgttgacgtcggtgcccttcaacttatctgccacgtacgaaacccagtatggattaactactacggaagcaaaatcgtattccttagcttccttaatgatttgatctacctgtgattgggtggcttctggtgccaaaattgtgtgatcaatgtattttgctaaattcataataaaatctccttattatttgcttttgttaacgcttacataatagcgccatttttatcatttgtaaacttaattattgaaaatatgttaagttaaaacgttttaccttagtgaaaacggggcattttgctttatagattaaggtttatcccacaaaattttttatacgactcttatttaaatgcgccaaccacaaaaaaattcgtcatcaataatcgggtttcgattattaacaacgaatttttacttagatacaaattggggatttatcggaaagtttggatgtcctaagctctcgaatttcacttggttacagaaaccggatgccttattaactaaacttccactccaattgcgaaagtcgcattcaactttccattttcgttaaatccttaaaactgttcgaaaaattatttgagcgtttattcttctaccaatactttttccatcacgacatcttctgtaggacggtcttcgtaattgcggtccactttactaattgcttcggccacgtccattccttcaatcacctgaccaaataccgtatgatggccatccaaccatggtgtgccaccctttcggtaagcttctacaatttcctctggaaattcagccgcctttagttgccggatcattttcttaggcacgttggtattagttacgatgaaaaactggctgccgttcgtgttaggacccgcgttagccatcgatagcgcgccatttaaattgtaaagctggttggaaaactcatcttcaaaggttttaccataaatgctttcgccacccattccagtaccagtcgggtcgccaccttgaatcatgaaatccggaatcacacggtgaaaaatcaccccgtcatagtaaccttgcttagccaattcaacgaaatttttaaccgtcttgggcaccaactcgtcaaaaagctgcactttaatgtcaccatggttagtttgaatcgttatcttagttccttttacgtttgctaaatctaattgtgggtatgtcatcattttctcctacttctcttttgattgcttgggccgttctattatactggaaaaatggagaagtaaaatcaaattttgtacgctatttattaatagttaataattaaataattggttcatatgaataatcaactttacccatatactgccgaacctcagtagggtgcccccgttttgctcccagttgatctcggtataatactcccatttcataaaataccatcgggttaaaataatctactactgaatcctgaattttgttcaatcctagtttttctgcatcaattacttctagttgtccattatattttttgatgaaatctcttgatcttgtatccattgctcgtgtttttccggcattgacgcattgaatgtatactttatcatcttggagaacttcaaatgggccgtggaaaaattccgccgaactgataaatgcgcagtccatccattgcatttccattaatgagcaaattgcaaatccgtaagcttgggaagtattagctccggatcccaagatatacataaatggttgtttacgatatttttgagcaaacttttgtgcagctggtaattgtaatcttctagcttctacaattatgtcatcaatcttatttagtccatctattaagtcttcatattttgagtaagtcggctctgtttcgtgaagatattcattcataattctgtataaaatccccataggttcttctttatgagagatttgttctccccattcataaacaataaacttgtcggctaatgctggatcagctaatgcggattccttttcatttgaaatggtgataacgtaagaaccatttttctttgctatcttagccgcttccactgcttcaggagtatttccactatgactaagcacaaaagtcaaactactttcatcccaataagccgggttcgttatgctcagctcacgagctgttaagcattttgaacgtagattcttactttcattttctacaaaatagtgaattggaaacaaatcattatatgaccctccacaagcagcgaaaaatacgtctttaatattgcgtttcttaatttccataaccaattctttttcgtttaacatcataaaatcctccaaattaaatttttaaggtactaaaatcttaaaataacaacaaacaatccccactacgaaggttcctaaaataatccagcctacaccaactccctttttcaataatttatacattagaaacgttgcaagtaatggcaagatccccggtaaaatttggtcaagcacatctttttgcaatgatagtttagagccagcttccccaaaactaatcttggtgttcatgattaagtaactggaagtcatcgcaccgattactaacatccctaaaatagatgaatagtaggaaagtttctctagcgctgctgaggaattcaatttttcgaagaagccaactcccattgaatatccgtatttaagtccataccacctaattaatgtgcatgggaggttgtacgcaataacaaataacaacggtcctagaaagaaacctttcaatgcaaacgctgcggcaatacttgtacaaattattctccaagtgctcatcattaatgagtcaccgattgccgataagggccccattaaactagctttaatactgctaatagttgttggatcaaactcgtcattatcagcgtatttttcttccattgatgctgttatccccataatagtagaggaacaaaaattagatacattaaaaaattccgtatttctttccatggattcttttaatttttgtggttgatttttaaaaatcttttcaagcaatggagtcattgcgtaagcgtaacccacacctagctgtttactatattcccaagatgcccccatcgaaaaagttcgccaaaaagcttttcgaaaatcctttttagttaaagcattagaactcattatcatcaccaccttctggttgtgccttagcagcatgtttttcatcataaaagtacataaaagcaattagcgaaacacctaacaatgcaattccaataattggaatttttaggtaagctactaacaaaaatccgatgaagaaaaacggtaaaacatctttcttcattattacttccaataacattgcaaacccaaccgcaggtaatatgccactagctactactaatccgtcttgaataaagtttggaatcattcctacaactgtcttggcaaaaacgttaccaagtacgaatgttaaggtgaccaatactattgagggtccaaaatggagtaaggttcctccccaaaacgaaaatctactaaaggttctagtccgaccttgtgcagcaatttcttcacacttttttacaaataatggggaaatcaatatatatactaggttttgtacgagtaacaccaacattgaaactggaagcccaaaagtaattgccgtagaaaaattaccgccactttgaatagctatactcgttccaataatgctagcggataccatatcctgtggagtcgataaacctatttcttgaactccgataaatgctaattccatttgcgccctaatgattaccccttgggacaaatcgcctaatactaatcctgtaactgcgcacattactataggacgatacgtttgcgctctgccaaacaaaaaatattcagcatagccaaagatggcaactaaaaatatcaaaaatgtttgcatagcaacccctccttaccttaaaaatcttttcgtttactcgtcggcacttgttgggcataaacttcgattcctaaatcacttagtttttgtaattcttctttttctgtaccagtgacaaaaattgcactagaaatcgcttctttatcctcactgtattttgttccgcctagattaagctttttgatagatgctacattagtgattaattgatatgcatcatcaatgcttttaaccactacaaacaacttatatttatcagttgcaccgttattaatcgccttgatagaatctgctacagacttaataactagctttaccccactaggctttgctaatctaataattgtcttttttgtttcatctccagcgacttcatcattagcaatcaaaatacaatctgccgataaatgtgatgtccaggaaaatgcaacttgtccatgtagcaaacgatggtcaaccctagttagtacaatcatggtaattcctccttatttcaaaatgtttcttctttaactgatctttccaataagtcattacagaattgaatattttttttagatgcgtgcagggttttccttacccattcttcagtaggctcagacgtgtttaatccagaaaccaactcaattaatagtggtaaattaagacctgctaccaagtaaaagtttttccgttttaaatatgttaaaaattcattattcacacttcctccaaaaatatcggtaattacaatcaactcataattggcatacttattcatcaatgcagcaattttttggcttaaatcgaaatccttttcaacgtagcaatctaaagcctctacttgatcactttctccgtaaataatcttcaaagaacttaaaattcccgacgccatctgcccatgagatgccacaataatctttttctccatatttaccagcctccacccttataaaagcaaaaggcgtgccaacttctggaacgcccttcctttattcaatcaagtcgctgatttttaggcatctgcttggataatgtctaaaatatagccgtattcggaggctgggatttcgacactataaattttttcaatcacactaaaagattcttttatccatttaaaaagccgttggtcttcagtgtcggaaagttgttctaaatcatagctggtaatcggttcgtttcggattaatcgctcaattaggcagctcacatgcacgtataacgacatttttgtgatgttgcctaactgatgcccgcttaactggttaaatttattaatggcgcggtcaatattatccatcaccaaatgcgcatccaaaatggtaatggaattaattacccgctctaatgaaaaactgtgaatcagttgttctttaaactgttggagctgctccgtagtcatgcatacttgcaaagccttatccaacttctccatctcgcttccggaaataatgctttccaaggaaatgtatggggcgtcggggagtccggggtcgatcgtccccactaccgccaccacgttgtacaacttattgaaaatggcgatttgttcttcagcctttaaccggtcaacctcgtaggcctgaatttgacagtccacttctgccggcatgctatctaacaacagttttttgacactattagctgttccaatcccggtaaagcagcaggttacgattagattgcgcttaatttcttttggatagataatttgcgttttaggcaccatcgcctgccgaacgtttcgcatgatttgctcaatatctttatgatgccgaatatcatcggccactagcaacgctgactgagttgagacattgttaacaatggcaatcggaaaatcaatctcactgctaatgaacttttgaatgccctccaaggagcccatatcaaccattaaaattagtccccggttaatttggcgatttttcacgtaactgctgaccttttcgccaatctccgccacatcaatatccaacggcatatcgatcgcgtccattacgtgttcgttaaataaattattgatcacgctggcaatgctgctggcagtcgaatagccgtgggagaggataatgcaacgaatgttttggctattggtttccttcttcacgctccgtaagtacagatggataaatagctcgtccacatcgtcaaggtgcaaattcatggtctttgcggtaattaaacgcagatccccaacaacttgatcgatttccgcatcctcaccatgaaaagtggcattaatttgctgaatgcactgttcgtcgcgttgtaccaaatgccagttagcacggttacggttgtaaaagtagtacgctaaaactaacgcgacgttgcccataaactgggtgtcactattgttttcgacgttagcaattcgatcggcaaacatctttttcaaaaagcccaccgacatgtcgcttttttccgtatccttcttaaaaattaagtagtcacacagttggttaatttcgtcgatggcattgtcaatgaaggcgttccgtttggctgtttgctggaattgctgaataatttttaacataacccgtttaatttcatcggtatacgcctgggattcggagattaaatcatcaattttcatggttggcaatacactgatgaactgatcgctaaacgatagcaaactcgcgtcttgaatattatggtcaattaccgttttgggaacgtctgctaataagatttcaatattcgaactttgcgccgcccgttgtaaactattggccaccgaaattaagatggtgttctttaattgacctacgttaccaaggtaactgctggaacttaaaatattcagcaccgaggtattcactaacactttgcgttgaattttctgggattggcggaggtaaaatagcttaaccaagttttcacgttcctgacgcggtcggtcgtttagttctgggatttcaatttgaatggggattcggcgaataaaggtgtctaagaaatggctttgaatatcttcggtagtcgcaaaaactagccgaacttgtacatgatgcccctctttagttgctcccaacggcgtgattatcccgttgtccaagtaattaaacaatttttcctgtcccttagcatcaagccggtgaatttcatcaagaaatagcattccgccatcagcttcatcaaatagtcccgtactatcttggtttgcgcccgtaaaggccccctttttataaccaaataaattacttgctaaaagttccggattgtcagcatattccgcgcaatttaagtgtacaaagcgggattctggtgctaaataccccttatccacgcaatattggtaataaacttgcgctaaataagttttccctgctcccgtaggcccggtaattaacacgggtaatccggtgcctgggtatccagcggccgctttcaatctttcaattggagtgtatagcgaaccgtgtccgccaattacttcgtcaaaggccgtccgtttaggctgagatacaatattctccaacgccgcttgactttcaaactctgtattttctaaaacgataccgtatcgttgttctaaagttgccctatcccaaaatttaaccggacgtgaattaagtttgattgcaaccttctctttataaagatcatttaagtacgcactaattgtgttccgccgcactcccaaccgttggctaaagtcctccgcggtggcgccgtgttcttgccaatcttctctttcagttaccgattgcagcattgctgctacttgatccttcaccataaaaaactctcctaaccaccatgaaaacgttatcaatttacggatagtgtatcccaggggagaaaagtgcgcaaggtgggggtggtaaccctagatttttatagctagcaaaaaaatatggggaccaatcgacaaaattcgattagtccccatattttttaataacttggacttgcgcccccttttgcttcgccgaaacgcgttccagccaccaattttttccggttaaccaaattttaagtctaaccgctcaaaccgcgattaaacctaaaatacagttaatcctgcattctattgctgccttgttgaaacgtgctccgaaacccagctccttccggctaactaaattatgggattaatcgttaaaaccgcgattactcccataattctgttagtcctcagaaactccccaggtttctccgcactctttttaatacatccgcccatattcatacgtcaattctggttcgcggcccgttcttgcgaacttatttagcttgtcgacttgcttcatttcttcatcagacagttcaaagtcatagatatcggcattttgagcaattcgttcttcatgaaccgactttgggatgaacgccaccccgttttgcaagtgccaccgcaaaaccacttgagcaggcgatttttggtacttatccgcaacctccttaagcactttttggtcaagcaccgttccgcgtcctaatgggctccacgccttggtaacgatgtcgtgttgcttattaaattcaatcactggtttaagggttaagaagggatgcatttccacctgatcaaccaccggcatttcgtgcgccttagttgccaaatattccaaatgaatagtttggtagttgctgaccccgattgacttggtcaagcccgccttcttcagatcctcaaacgcgcgccacgtttcaaaaaagtgttgacgaactggccaatggatcgataacaggtcgacgtagtccatttgcaacttcttcagggattcttttaccgaggcaatcgctgcgtcataaccttgccgcgcctccgtcactttggtagtcacaaaaatatcttcccgaggaatcgcaaactttttaaacgcatttcctacttcttgttcattttcgtagagttgtgccgtatcgaacaaccggtagccattttcgtaggctgctttcaccgccgtgtcaaccgctgcttgtccacgaactttatataatccaaagccttcttgtggcatctgattgccatctgccaacgtaatcaaattattttgaatatccatttgaatgagctcctttcaatgaaccttcttgttacgttaagcatagcacttgctggatgaatttgtagtaaattgaccattaaatttctttgaaatacgatggctgcttgccatccttaatattgtctgccagggataacaaaaatagtggaattagaattctctccaacgaattccaattccactatttattttttcataaagttaaaatcttgaccgccataatcttcaatatattggtacaaaatcaattccatcaacgcaattgtagaaactcgtgaactgatttcaacgtcattaacttcgattacgtcagcaaaaatatataaattaatatcgctcaaattctggatcgtgttgttatccggctcagtgattgaaattaaaaaaggtgtttgcgccgctccttttaactgtttaatcatttctaaaaactcgcgattgcgcccgttatacgtaagcatgaaaactaaatcatccgatttaacttgtttaatggccattcgccgaaaatcgcgatcccggggatactttaccgtaaaccccgccatcgtataaacataatatacgtaatctgccgcatacttactaattcctttagcaaacaggtaaatggtgggatgattagccagttgtttagtaatctcgtgtaatttcttaggtgggatcacccggactgattcagtaatattttttaggtattcttctcgataatcaacctggctaacttcgaacggcatctctttttcttgctcgtttttttcgttaaggacggtatatttaattaccgtggtgaattcgctaaaccccacaaacccaattttcttgacgaaacgtaggaatgttgccgttgatacgtaagtttcactagcaacttcgcgaatactttggtttttaattttatccatgttggaaactacgtagtcaaatagtgcttgttcatttttggttaacgtactgagatgtgactctacaatgtcaaaaaaattcataagccaccctcccattaatgtcccggcatgttaagcacgactgtatgtaatccgcccccacccgttaatatttcggtagcgggaaaaccaattatttcccggtcgggataataattagctaactcttggcgggctttttgatcattaggatcgttaaattccgggaaaataatcgcctggtcaagcgtaatataattaacataagtagcggttaaccgttgcccttccgtgcggggtaacattccgttaattgtatcaaccccttctgcttccagtgccgtcaattttaccagacgctgtggcaaatccattttatgaattattaaatttcgtccacgagcatctgttgtctgacttaaaatgtcgtaagcacgctgactaatccggtgctgcggatcgcccggattatcggtccacgacaaaacaatttcgcctggtcgaataaaattaaccatgttatccacgtcacccccagcttcatctaagaaaaatccttccggaagccaaattaccttttgggcacccaaataattttggaaaacctcttcggcttgagccttagtaattcccttattgcgcccttccgaaagtaccacttcttcagtagtaatcaaggtcccttccccatcggtcactaccgaacagccttctaaaataaagtccgactggtaacggtcccagccaaataagtcagctaactttccggttacctcctggtccttatcccaaggaaaataaagaccatcgagcaatccaccccaggcattaaacctaaagtccatacaacgcaccactccatcagcattaaccaattcaatcggtcccgtatctttaataaaaacgtcattattgctcatttctaaaacccgaatctgggtgggtaacatcgctcgcgcatttttatattgattttcgtttacaaacaccgttactggctgatagtttgttattaatgttgctaactgtacaaaagatttttgtgctggtttaccaccgttacgccaattatcggggcgttgcggccacatcattaaactttgtcccttggattcgaattcggctggcatccaaaaaccatcctgttggggaattgttgttaacttcattgccaattaatcccttctgactttttttcgtaattctccttctttattcgaaaaattgctgaattacgaataattaattttactctcaaaacatggagcacacgctaatttcattcaattagttttccatatttgaaaataaaaattgaggtaggattatgcttttcttcccacctcaattattttcctcatcttagcgttgaggaacctgctgagtaatacagtggatatttcctccaccaagtaaaatttctcgtgcgggaacacctaccactttgcgatcaggatataattcgctcaacactttttgagcttccttatccatagggtcgttaaatagtgggaaaataatcccgccatttgcagtgtagtagttgatataactagctgctagacgctcgccttccgttcttggtaacgtgccatcaaccgcgtccaccccttcactttctgctttagtgatccgtactggtttaggaactcttaacttaaccaccttaagtttgcgaccttgggcatccgttgcattttccaaaattgccaagttttctttagaaatttcgtattggggatcattttgatcatccgtccaagcaagggcgactaccccaggtttaacaaaattagcaatgttatccacgtgcccgtttgtttcgtcttggtagattcccttcttcaaccagatgattttttccaagttaaggtgttctttaagcacttcctcgatttggtccttagagagttgtggattgcgaccttccgataataggcattcttccgtagtaattaaggtaccttgcccatctacgtgaattgatccaccttctaacacaaaatcatcaagccggtaccgatctgtttgttccaattctgccattttctgagcaacacgatcgtccttatcccatgggaaataaagtccgtctaccaaacctccccaggcattaaacgtccaatctacagcgcgtaattctccgtgatcatttttcacgaaggtcgcgccacagtctcgaatccaagaatcgttgttggaaatttcgattactttcacctggtcaggtaacatattccgggcgttttcgtattgatcgtcattcacgcccaccgtcactggttcaaattcggcgatttcctcggctacctgcgcaaaagttttttgggcgggcttaccgccgtttcgccaattatcggggcgttggggccataacatgtaggcacccgcatgctcttcaaattctcctggcattctaaacccatcttttttaggggtactatctaaggtcttcatttttgcgtctcctttatttttaaacgttggttaacttctcgacgttcagcaattctaacaactaattcaccaactactagggtaacaataaccccaattaaaatcggcaccttggcagataattctgcagcagtagtattcaagggtactgcagtaaagattaccgtcagtaaaagtaaaaactcgggaatccacgtcatgcaccacagtaaccccttcccaccgggaaccttaaacgggcggtctcgttggggatcaattttacggagttttaaaaaggctggaaacatcattgtatacgaaagcagaagggcaattacgtttaaagagaaaaatgcccaaaaaatgtcttgattaggaatcaggggggcaaccacgattaagatggtagctaccacaccgtttaaataccctgttccaaccggcatgtgctgcttattttcaatcccaaatacgtttggtaaaacatgatctttcgctgcgtaatccgctacgtaattaactcctagtgcccaagataccatttcagaaactaaaatgtacaagaataaaactccgataacaacgacaaaccagttcattttaccaatcaagaggataaaactgtctagtagcccgctcgatgctgacaactcgttggtaggaattgctgcactcatgccaaaggccgacatcaagtagaaaactgcaattaaaactcccccataaataattgcttgtgggatttgcttgcgggggttgtccatatcatccgccatggtagcaaccacttcaaaacctaggaaattaaaaataataatcgataaattacttagactgttaatgttcatttggggtaaaaattcccgcggcgcaaaactatttgccactcccctagttaccgctacgtaaattcctaatcccgttaacgaaaggatggtaaaaattttcgcgaatgctgctaaattcataatccatttactttcggaggccggttggttaccaacgattaccacgaaccacacgaaaattaattgaataccaaccgcaagccacgttcctagttttaagttaaaaatggtttccgccacctgggtgaaaagcactcccaagctcgccatccaaatcggatagttaatccaatatagccacgctagccggccgccccatcgagaaccgaaggcttgtttcacccagtcgtataaaccgccgtctcccgtataagtcgttcctaattcggaggaaattaaaccgtaaggcaagaaaaataaccctaagagaaaaatccaccaaaagaattgtgaagtgccaattgcagcagccggagcggctgattcaactaccaaaattaccactaccgacatcaatactgcatcaaatagtttgaatttcttttttcccgtttccataatataatctccaatctatcacgcaccatgcgcttaaaacggggttagccttgccgtctttcaggagcattccgtagcattaattctaattcagcatcataatgcgctgccactgccggcgaagcatattctaaagtgggattcagtaaataaacaaaaatcgctcgcatcgccgttttccgattttccgcttcatcccaaacaatcgaataatcggaatccaaaacttcatcagttacttcttcccctcgagtagctggtagacaatgcataaatttaacgtgactgcttgcctttgccatcaattcggcgttcacctgatacttagggtagaaaattttcattcgttcttcctttggcatttcatcatcatacaaaccgtaccaaacgtccgtgtaaacaaaatctgcatcttgtaaagcttcgtcagcattttcagtaattgtgacactcccgccatattttttggcgttttgtttgcccactttaaccacgtcgtctttcatttggaacccctttggtccgtattgtacaaagtccatccccatcttagttgccataaacattgtggacacgcagacttgtgtggcatctcccacaaacacaatcttgcaatcactcaattgtttgcctttcggaagatgttcttgcatggtaataatgtctcccaattcttgagtgggatggttataatcactcataaaattaaccaccggaactttggcgtatttaccaacttccgcaaccgtcttgtgccgatcaacccgggcgccaataatatccaaaattcgaccaagtacttgagatgtatcttcaatggtttcatgtccaccaagttgaatttgcccagatgccaaatattgcgcatgtccacccaattccgtcattgcggcttccgcagacgtcctggttctagtagaactttgctcaaaaatcattcctaacgtcttgtttttcaacaatggcgggtaatatccgtttttgatggcttcctttaatttcagcccgaggtgaatcatgaacctaatttcttcctgggtgtaagtatttgtatcgatatagtcgcgttttgccatttccaaaacttcctttcatgtaacttagcttgtttacatttacatcatagtgggcggcttttgtttattaaagcgttttcaatggtcttgcaactcgcattcacgacttgtaacgcgtgtcattttatgaaacatgtcccacttttcaaaaatccctttctaattgcttttccccctacaaccagctaggataaagttaatagctaagccaaaggacgggatgatcatggataacgcaactttaaaatatgttttagatcagttatacaaggaatatttaattcctttattcctagttaatgatcaatacgaaatcgtgattcccaaaactaactggagttcgcggaactttaaagaacaagtcctagaagaaacccaccctaacgagattcgttattttaagaagggcgctttcttttatagtaattttgcttttgaactttccgaatacgggactggaaccgtaatgattgggccgtgtggtgctttagaagctggatcagattcaatccattttcagggacatacttattttgctggaatccattacagtaaatcttctcgggaaggatttgagcaatttactaacttaatttttgcaatcatccgtggaactttgggccaaaaccaaaagcagcactggtattatgatcgagtctataaatccaccaattatcacttagcccaaaatctttcgagtcgccgcgatcagaaaaacacccttgactcctacgaatttgaacggcgttacattgaagcaattcggcgaaacgagccggataagataaagtggttgttcaaaaagatggcggatacctacaaagtcaaactatcggacagtgacttggagggtttgaaatataaatatgcgggattaatcacgatcttaacccgggtcagcatcgaagacggcgtcccagccgagcaagcgttcagcctttctgacgccctattgcaacgtttgcaaagcatttatacttacgcggaatgtttggtttccgtccaggaagcctcctacaaatttatggacatgatccattcctaccagtacgcaaccaaaaaccaattagtgcaaaaaatactaaattatatcgatgagcatatttacgatcggattaccctcgctgatttggctgatttcactaaccggcataaaacttcaatctctacccagtttaaaaaagaagttggccagccgattcacgtgtacattaaccacaagaaaattcaggaatccaagcatttattgctatttaccgaactttcattaaaagaaatcagtggcctattgcattattctagtcaaagtcactttgtgcacacgtttaaacaatttatggggatcacccctggcgaatttcgcaatgaaaatttaacttatcattttgaataataaaaaatagagagtgggataaaagtcgggcaatttgtgagcattaactgaaaattgaccattatgcctgaatttggcataatggtcaatttttggttacgcggaacaaactgtcttttggcacacgttttggctctcttgaagtcaaaacaccaaaacaactttttaagaaccttttcatccttgaaaagcatttttttactttttcccagcctccgttttttaatttttaatagttcaactaacgcccttatttgtcaaattagccatcatccgctggtaattagtcgcagtaatcatcactttccggttaacatactggatctccttagttttagttagttctttaattactcgatcaaccgtgcggatgctaattccaagttctgctgaaaattcccgttgctttttatcgaccgctacccgatcttcgtccgatcgattattttcgtaatattccacaaaataaattcgcgcccgatcaatccctcgtaatcgatagaaccgaccttctttattagaaacttcgtataaatcattagctaacaaagctacgcattctcgtaacaacaccggatcttccattattttttgataaatcagtggcgccggcactttaaccaaagtaacgtccgttaagcattctaccgctgcggcatagtgaacttggtgtgctaacacctctaacaatccgatgttgcccgccttattgtctgccaaaaaatatgtaaattcattaccgtctcggtagatttttttacccacaaccaatcccttcacgataaaatacacaaattctgggtaacctccctgttcaattaactgccgtccctttgaaaattgaaccatttctccacattcttctaaaaaaggacgcacgcttgcgtaattaaataagttatcgctctggtaatattgccataattgcgttagtttcatgtttgtcattaagatccccaaccacaccgtatatttcggctagtttaactactacaccgttaaacagatcatatcatcttttaatccaatttattcgtaatcgctgacccggttgaacacaaggaaaataatgttatttgcaaagtaaaccattggaataatcattagcgtaaattgacccgaaattaaataggttgtaagcattagcacgttgagtaagaagaagaggtattcagccataaaataacgtttagcaagtaaaaagctcgcaatcaaaccggttccggtggtaaacgccccactcaataacccttgcccctcgtggccaatcaaaatcaagaaaccaataattacaaacgcaattactacgcccaaaataagaatcataattgcttgtttatcaattcttttaagctgggtttgtccgtcatcagtatggtgatttttccagtcaaaatactggataaatgcaacaataatcccccaaaaactcatcgggagcattgaataggtctgtgccaaaaataacgcaatgattgtcgtaattaaatttaccaaatcagggtagataaatttcacgtcccgtttagtggtcatataaatattcacaaagcccgcgaacatcgaaataatggaaacccaaatatataattcttgaactgcccgtcccgaattatttaatattggcggaaaggtttgttgaaaggagaaataaattccaattaaaagtgcaattcccaaaactattttcaataactggtctctaagttttacccgcttttccatcaaaaagtcctcgctttcttagcctacgtgatgatcgaaatattctaggccatccatcaaatatttaacgtatttttcccgattagaattcttcagtaccaagattcggttccgccattcaggctgttttctagtgtcggcaatgctcattccgcgggcaacgccttcttcagtagcaaccgataccgattgaatttcacccgtgaaagtagtgggatctaataggtaaaccaccgtgcacaaatcatgtaacggactatctttgaagccaaattgccgccccgaaacattatagaagtctaacaattgataaattttacgggaaatggggcccttggtttgcagagtatcaatttcttcccgggttacgtatgatttctcagtaacgtccaggcccgccatcaccacttttacgcccgcgttaagtacgatttgcgccgcttcgggatccacgtaaaaattaaattccgctgccggactataatttccgtgatcaattcccccgcccatcaaacaaatttggttaattcttgtcttaacttctggataagcctttaaaagcaatgcaatattcgttaacggcccaattgcaacgatatcgaccttttctggattagccatgatggtttcaaacatatactgtagtaagttcacttctaaaatcggataatcattgtcaggaaattctagccccgccatgccggtttccccgtgagcttccggagcactttgcagttctttaactagcgggcccgcctgacctttaattaaaggaacctgcgcccctagtaaattcaataagttctttgcgttgttagtaacgttttccaacgggctatttccaccaatcgtagatacacctaacacttgcaattgctctggattagctaacgcaactaaaatggctagtgcatcgtcatggccaggatcgcaatctatccatatctttttcattcaaaactccttaacttaacctaccattactaaaactttatttgatgccttaaattttcctacgaagtaccgataaataaaatgtcaaatggcaggttttggcaaaaaaatgtttatcacacgacaaatttgatgtttttttcgctagaatacgaacttaaccaccataatccctccctatatatccatcatcatcaaaaaaagacccaaaaaatttctgagtctttgtcaaatagtagcctaattatcaacttttaataaatcaccggtcatcggtcgggttgctgagtatgcttgttggtaaattcggtagatttggtcgtatttcgcaacgttattagctttaggacggtaaacttttccatacttcacaaacgtctccgagcattctgccaaatctttaaaccaaccaactccaacagccgcaagcattgctgcacctagcccaggaccctgttcgttttcaagactaactacgttcatattaaaaacgtccgcctgaatttgcatccataacgcactcttggcgccaccacccgtagctaccgcagttacaaaatgcttgccttcagaccggtaaatcgacaacaagtcacgaaaagagaaggtaattccttcaattaccgctcgagtaaagtcgtgaagttgctggcgactatccatgccaataaaacttccccgaatctgagcgtctgcatacggcgtccgttctcccacaatgtagggggtaaatagcagccccttagcaccgatcggcgattttttagcatcttccactaggtcggtaaacttttgctgacctgcaaaagtttgtttaaaccaacttaagctgtaacccgccgctaacgtcactcccatggaataataactgtccggaattgcgtgattaaagaaatgcaatcgtccggcgtaatccgttttacgatctttttcgtaagccaaaactacgcctgaggtaccaatactggataaaattttatcttcactaataatccccgcaccaattgcaccagccgcattgtccgctgcgccagcaatcaccttagtttcagcaggcaaaccggaaattgcactgtaagctacggttatatttcccacgacggcagtggattctaataatgggggacagatttccaacggtaacgccaattcatccgcaatttccttgctccaagttttatgaatttcatctagccacaccgtcccagcagcatcggaatattccatcccaattttgccggtcatgcggaaccgtacgtaatctttgggcagtaagaagacttcagtttgcgtaaaaatttctggttcgttttcctttacccataaaattttaggcaaggtaaagccttccaacggacgattgcgggtgatttttaaaaaatctccccttaatttatccgtaatttcttcgcattgggcagtggttcgggtgtcgttccataaaattgctggccgtaacacccggtagtttttgtccatcagtaccaatccgtgcatttgccccgaataactgattccttcaactttagacaaatctaaatgttccaccgctaccaaattttgaattgctagcgtagttttctgtacccaatcttccgggttttgttcactataccccgcttgcggattgctaattgcgtattcttgactactttgcgccacgtctgctgccaatgtagccgcgacgttgtatggcgttccgccagctaaatcagtaaaaaacacggtttcctcaaaaggtgcatcacctaaagcatggacgaatttttgatgtaaatcttggtcgctcatcccggtcgtaaaatcaataaattgccaatttttcggcaccttaatcagtaaacttagggccgcttgaattccagacgcaaatccgccgtggccactcacaattactttaatctcgttcatcaattatctccgttttattcgctaatcacatccagccaattgctgccatgataatcgataaggcaaaggtcaccacgatcagccaaatcgggctaatgttcttccgcaacagccaaaacagtaagaatacgaaagcaaatggcaaaatgttaggaaaaatcttgtctaaaagttgcttttgcaggtcaataacggtgttcccggccccaattttaatggtcagctgcatctttacgtacgacgcaattagggagccaattacggtcaatcccagaatagaagcaacgtgcgaaatgaccgtcgaattttcttggattacgtcaatagccttggttcctaggttgtatccaagatgagccaggggtgcccgagaccagaagaggaagaggtaaaccacgaagaagaggatggggccaaagacgtttccgtttttagcaattgaggcgctaattccgcccacaatcggcataatggtgaaccagaaaattgcatccccgattccagccatcggcccgaacaacgcgttcttcaatcccttaatggtggtcgaatcaacgtgctcttcttccatggttaacagtagtcccatgagaatggggtatagcggtggcgagctgttaataaattccatgttgtcggtcattacccgctttaatccctcaggatcgtcacgatagattttctcccaatagggcagttgtgcccacgtccatcctggtgaatgcatccgttcgtaagaaaacgaagcctgtactaggttagaacgaataccgagcattgaaatttcatgattgctgaaaatggattttttattcttagataccatcgtccatgccacctccttgcgaacgtgcagaaaggtccttaatttgggcctttaattccatattttcccgggtccggaagtattcaatcgcggcaaaaacgcccccgaccaacgctaccggcaatacgtttgaaaatggaatcatgctggccattacgaatcccaagactaagtatggcatgtatttaggtttcagcattaccttaagcaacattgcaaaaccaaccgctggtaagatcccaccagccaattcaaagccgtgggtcaaccaatgcggcatcgaatttactaaagcgtgcattggagtttgcgcagcgtaggcactgaggaaagctaccacgccaaacgaaacgatgacaatcgttagcggaataaaattaagccgtttgaaatcacgggcattgccttccgctgcgtattggtcaaatttagacatgaatagggaaaatgatgagtagaagaacagtaaaatatactgcatgagcatcgcaaatggcaacgataagccaatcgcggtggtagggttagtattattcgtggccgcaattactacggtcatgatcccgcataaaactgtgttaggcggttgagttcctcccgccggggttagtccagcaaaggctaattcggtcagcccgccggcaatgacccccaattgtaaatcccctaaaatcaaaccagtaatcgtgcagacaatgatgggccggaaaatgaagaaagcttgcagccaagcatcaaggccggaaatcattgcccaaatcgcaattaaaataccttgtgtgagagtaaccgacatttattttcacctctcttgataagcagcgcgcagtagctgaatcgtcaggtatgtttaaaactaattggctaagcccgaatactcaagttactgagcacgtttagcgacattgttataaaattgggggggctaaaatcacttcctttacactaactagatgttatttcaataattgttcggtaatcggatattgtttttcaccaggatagtcttgaataaaaatttcaattccccgattagctactgcgaggaggtcgtgaacgtcttgatcgtcaacgtaaacttttttggtgatttcccgtttaccttgcgcgaaatgcatgttgcccactttaactttattaaccggcacgccgccttccactaatttaagtaagtcaccaggcgtttttaccaccaaaaaaatgtgttgtcgatccgcagtcttgttgatcacgttaatcgtcttttcaatcgtaaagaaccgaatatccgccccggaagaatccgcggtggtggccatcaacttttgttgcagttcgtcattggccgcgtcgtcattagccaccacgattaagttggcctttaccgccctggtccaggtcaccccgacttgtccatgtaccaaacgattatcaactcgcgtcattaaaatattcgctgccattacatccatctcctcatcagataaatcccatctaaccccaacaagtgtaaacgtttacaaataaagtataacctttatctaaccaaagacaatcgttaaattgccattttttaattaaaaatagtttgcactaacaaccttatctctacacaatttttatcacctttaagatgtatataccaatttttaaccttaaagattttgccaactaaaaaagtgcttcttcagaacttaaaaatcctcaagaagcacttttgatgctaataaagttagcacacccaaatgattttatatttttccatccttcgggtagtgcttaaactactaatctttacggccttgaccagccggcagaatcgtacaaatcctgcgcctaatcttcccgctgaacttccacgaccgccggactcttcgcaattttcattaaaactgcgtcaatatcctgcttgtcagttaaaattccttccaattccaccgtaatccgctcggtggttacgttgctgatggaaaatgtattccgagtgaaccccacgtcatgaaaaattgcgtggatcgtcgataaagtcgtagcgtcgtttttcaatagaatctggcagtgaaaatgtttgtgccgtaataaatattttaaaactaaattgtcccggaacaaggactgcgaggccacaatcaggagggcggccgcgattccgatgaagtacaatcccgagccaattgccatcccgaccgcggcagtggcccacaccccggcggcggtagttaggccgttaacaccggcgccccgcactaggatggttccggcaccgataaaactaatcccactaatgatttgcgccgcaatccgggaagggtctaacccaattccaggatgttgtagtaaatcgtagaaaccatatttagagattaacatggctaaggcagctcctaaagctacgataatgtgcgtccgaattccagcatttttcagccgggccgaccgttcgtagccaataaaaccaccacaaattgccgccactacgagccgaaaacaccagtctaaatccatggcttgcattgtttaacccccttacagcaattaaaatcgtccaaattcttcgcttcaattttaccactctaaataaaaacacggttcccagtagccttttgccaccaagaatcgtgtttggttcgtttagaaattgcttttaataatcctgcgagacttcgtcaactgatctacgttatcttcaaaatgtaattttaaaaaggagtagtagagtagatcaaccacgtacagttgggccattagcgaggtcgtcgccgcgcttcgcagttggttaccttccccgttatcactatgggcaaggaccaccgtgctttgtcgggccaggggactgctcaatacccgggtaatcgccactacgggcaaatctaacgtccgggctgcacttagtaattgtaacgtctctttagtttctcccgagttagagatcagcacgaccaccccacggcctttggacatccccgctgccaacaggtgcacgtcttgggtttgggcgactggtttccccagccgcacgaacttctgttgcaaatcatccgctactaaatgggacgcacccatcccaaaagtgtaaaccacgtcggcttgatccaccagtttggctgcattccggactgcgccgcccttaaccgttcgattggtttgctcgatggtgtggttaatccggtattccatcttttgtttcatcacttcgagcgtatctgccggattgatttcttcaaagaacttgtcgttaaccatcgtttcgtttttcaggcgttctttcagctcgggtaacccgtttttacaaacccgtttggctaagcgaattaccgttgcagcgctcgttcccacttgatcagcaacctgtttggcattggaatcaattaccacttgcggatacttaatgataaagcgggcaacctgcttttcctttttggtaaaatcacccaactgatttttcaagttaaatacaacacttttcatcgacacccctcctcacgctggcgtaatgaataagtggatagcgttgattctccattaaaattgacgtagcttggacatcggtttgtccaatttttttatcaacttgataatcacccgaattggtgatgattgtcaaggtcactggtgcaagttgtgcttcccggattacggaccaatcgaccttaccaattacgtcaccttggtgcacttggtcaccagcttgaacgttaatttcaaagccattgccatttaacttcacggtatccaccccgatgtggacgaggacttcttcaccaatctcatcttggaaaccaaccgcgtgcttagtgtcagcaaccatagtaacttttccatctaccggagcgtaaatttggggatcagtttcgtcaggcattaccgctaccgattttcccatcacttcttgtgccatcattggatcaggaacttgatcaagttcgactattttaccgctaacgggagttgtcacggtcgctgaaccgctacgcacggctgtcgcgctgcttggcacatcgttttgaacttcattttgaacttcagcgttaacttcagcatcgccaatgagggcgtctttagggattccaaagaagtaggttgccacgaatccgccggcatatccggctaagagcccgaggacgtaggcgtaaatgtggccgttagtgattaacggaattaaagccactccggaaggaccgattgcaattgcgcccacgtgaccgagtccgccaactacggcaccaccgatcccaccaccgatacatgcggtgatgaacggtcgtcctagtggcaacgttaccccgtaaattaggggttcgccaattcccagaattccaactggcagagctcctttaattaagttagtcaattggcggttccgccgacatttaatccagagggcaaaggcggcgccgacttgtccagcacccgccatggcaagaattggcaataacggagtcgcccccgttttgttaatcatttcaatatggatcggggttagaatttggtgcaaaccaaacattaccattgggaggaataaggctcccaacgcaaatccagaaaacgcgccgccaatgtttagaatccagttaattgcaccaactagggaacttgaaattacgccggcaactggcatcactaggaaaatggtaaatattccaataactaataacgtaatcgttggggtcacaataatatcaattgaatctggtacccagcgatgaagttgcttttcgactaaggaaagcacccaaacggcaaaaatcaccccaatgattccaccttggccggcactcatgggttgcccgttaaaaatgttgtgtagcggagcttcgggagtcatcccgtttaacaaggttaccgccccgattacaccccctaaaccaggggtcgcgccgaactcggtcgcactattaataccaacgtaaacggaaaggtaggcaaacaccccgtttttaatgatgttcagtactaaaattaaatccgtccaactcttactgatatccccagccacgagcaagttggagagcaccgcagcaatccccccaattaaaccagccccgacaaaggccggaatcaacggaatgaagatgttcgaaatcgatttcaaaactcgttttacgggagtttgcttttgcttagccttttgggccgccttcacttgagcagccttggcttccacaatctccttgtcggtcatcttacttgtatccatcaccgtttcaggaaaaggatcgcccagttttactccaacttcgcggaccatttcttcggcaactttattaaccgtgcccggacccacaatcacttgtaaagtgtcgtcgtccacgactcccatcacaccgtcaatttgttttaacccggccatgttaaccaagctaggatccttaatggtcatgcgcacccgcgtcatacaatggatcagtttggctacgttgccgggaccgcccacgttagcgtaaattgcctgcgcgatttgctttacttttgcatccgtcattactttttcctcctaatcaatcgtctttctaacaaaaccgtgggcttcttgaagccgcttttgagcttccgcttcgtcaacccccgtcaaaatcatcacgatggcaaccttaacgttttggtgggccttttcaaacactgtggctgcggtctcgtaatctgcatcggtggcttgcataataatgcgtttagaacgttccaccaatttagcgttagttggtttaacgtcgaccatcaaattcttataaacttttccaattccgatcatcgaaaccgttgaaagcatgtttaacactaatttctgcgcggtccccgattttaaccgggtggaaccggtcaagacttcgggacccaccggtacttcaatcgcaatttcggcatgttgactaatttctgcatccgcgttgcaggccaaactaatcgtggcagcgtgcatttctcgcgcgtagtctaatccgccaattacgtacggtgtccgaccgctagcggcgattcccactaccgtgtctttatccgtcaagtgtcgtttttttaaatctgccggtcctaaagttaaggaatcttccgcaccttctaccgccacggtcatcgccttttcgtctccagcaattagtccttgaaccatttccggatcagtaccaaacgtgggcacgcattcggcagcatccaacacgcctaaccggccgctggttcctgcgcccatataaaaaagccgtccgccttgcttaaagtttttgacaatttggtccaccgcttgagtaatctgcgggagcgctttttgtacgctttgcgccacggtttggtcctcgtggttcataatttcgaggacttctgccgttgataattcatccaaccgcatcgtctgcggattacgggtttccgtcgttaaccgacttaaatctaacattattctgcacctccatgtattcgctttcatttgagttgcttaattgtaccgcttttgaaatgccatttcaataaaatttgcaaatttattcaaaaatatgaaaccacatttcatttaaaaacaaatgtgtctgctaagttaccggttaatgggcaaaatgggcttattttgccttaaatacttgttagcgtgatagcgctttgataatattcaaatgcaaaaaaatattgattagtaatcatttcggaggagattattttaatatggaagtcaaactgaactactatgatgaatttcagcagctcagctcaagtcaagttttttcggatcagaatcgggatattaatttaccattcatcaaagatgcacgaatttttagcgatactaccctttatttgcaagatattagccattggcgctgccccggttctaccttgattattgacaccgaacgacctccccatattactaatcaatcaactcgaaaacttatccgtaactttttacgcgaccagccctgttgcgacatctttttacgcgtggtaaccgattatttaggtattaaacaagcccgcccggtggttttaggtacccaacgggtggtgccgctaaacggaactacccggcggcccgcaaattggatctttgcccaccacctcagtgatttttatacggaccagcaccatccgcactcttcgttcttgaattttgattgtaacggcaagtgtctccaactccaggtgccgtttaaagaaacgtacattcggaataagttactgatggcccagcaaatggccgaattaacttacctaataatgaaaggcctttcagaaacgttcgggatggcagttatcaaaccacgaaaagaagttttcgcgcgtatggaccattaccttcaaaaacctgctttaccagctaagcccctagacgaaacctttattggattgtctgcacgtttatttgttacgcttagcgattcatttttcgacgaatcgctcatgtccatggaagaagccacacataaactcaaaaaaatgagcaataatttagagttaatgtaatgttttttgccctaatttcttaaaacaaagtataataaaattagttataattcgtactttaatttaactaaatttaaacgtgttggctgacaccttgggggattagtttttatgaacgaaacactaaatagatggataaagaaatttaagcactggatcaatccgcgcgatccgtaccaaaacgaatttgtcgaagacgacctgtatcgggggcggcggtccgctaaacgacggcatcggcgtttagtgatgcggcgttggtcaattttaattggtagcattattttagtgtgcgccgtgctttttggcggcggatggggaatcagcaaaacgctctacgctagcaaagttgaccggctacagacccggatcgaccgcttgtacgtcgattcccaacattcggatctaaaaaagaacgtcaccaagcaacaaattactacgcttaagcatgacgtcgctcagttaaaagaccggccgaagaaacaaacgttacaaaaggcccaaaaccaagctgccaacgcttaccaagttcggcaggattaccaacatttgttcaaccggcaaaaccgggtcgacttgaaggtgactactaaaaaagtcaaccaccaaatgcagactttgtcggcaaacagcgttccgcaagctttcgataaaaagtatcaacagcgtctacaaaaagtacgtcaaattgtccaaacggcggataaacttagtcgccgctacaacaccattattaaagctcaccaacaaaaccaaaaaattagcgtttccactattgatgggttaattaaggacatgcggaagaatcagcagtctcaacggaccgtcgacgaacaaactaagttaattagtctgcgttcaatcgtcaataaggaaaataaagcggccgaaaaagcggcacgagaagcagccatcgcagcccaaaaagaagctgaagaagaagccgcacgcaaagcagccgaagaatctgcctctaaagaagcttctaaatcagcttccaaggcggcggaagctagttctaaggccgcggcagagtccagttccaaggcagccgaagaaagcgcagctgccgcatcttcagcggaagaagaaagctctagctatgatagtagttatactgatgggacttacactcccgcatatgatggtaattattcatcaaatagttacactaaccctgcttattacaactacacggacagcgaatctgacaatggttccacccaaagttaatatcaaaaacacgcagtggaaacaaaagctgactagctagtctatgaaaattaaaagcagctgaaaaaactagtttattccgcttaatcaaaaacaagagtgggacaaaagtcaggtagtttgcgagcattaaccaaaaattgacttttggtacacgttttggctctgttgaagtcaaaaaaccaaaataaaaacggttcatgaagaagtttcacttcatgaaccgtttttttggttagagccctttgtcacagccccttttggattaatactcacaagctacccgacttttgtcgcactcgctttttacaatttttagtgaccacctaatcttcagggtggtcctggtcccatttttccgcttggctgatggcaatcgggattgcccggtcttcatcataaccttcttgtaacaaagcatttgcaatttcaattgctttgttacgcacccgttccttgagatttttcatggagctgggataatctttttttgtccaaggcaccgccattcctccttaaaggttgattggttcgccaccagttacgccgtagatttgggaagttacgtaactagctaagttggacgctaggaagacgtatgctggggctaattcagctggttgtccagcccggcccatcggtgaatcttgcccaaattcagggatcgaggattctggttgaccatgatccaattgaattggagtccaaattggtcctggagccacgccgttaacccgcaccccttgttcaatcagttgttgccccaagttaatcgtcatgttcgcgattgctgctttagttgcggcgtaatctaacaattgggtgcttgggttaaacgcttgaatcgaggtggtggtaacgatcgcgccgccagctggaaggtgcggtttggctgccttcaccatggctaacatggcaaccacgttcacgtcaaaactatccttaatttgttggatcggcaggtcgtcgattttttcgtgcgcaatttgttgggacgcgtttaaaattaacgtgtcgagtgcaccaaattcatcgaccacccgttggataatttcttcgggagcatttgaatcgcgtaaatcagccgggagtaagagcgcttgacgccctgcggaagtgatgtagtgttccacttcttgcgcatcggcttcttcacctggtaaaaattggatggctacgtcggcgccttcccgggcaaatgcgatggccaccgcgcgaccaattccggaatcacccccggttacaagcacctttcggtttaacagcaagtcgtgacctacgtaactagtttcaccacagtcgggtacgggggtcatcttcccttggatcgctggggtgtcctgttgttgcgccggaaatttatccgtgtggtacagcgtacggggatcctttaaatctggttgattcatgtgcatacaactcctttcttttgtaattagcattttaatataatagaatatttttaaaaagaaaaaggctcacgttatgtaaacgtttagcgagaaaggagtttcggcatgcctaatcaccacgtccagctcaaaattgaaactttcaccagtgttgattctctcaacaatttaatccaaaaacatcaatggccggcaatcattacggcaggcctgcaaactcccgaggtctttccccgaaccatgcgtttcaagcatggtgaagacgaaattgcctatttgatcgcggtctgtaacctcgcgcctaccgataacatccttgactcccaggtattgttagaccctttaatcatcgtttcagagccggaacaactaacctttttggtccacgaagaatcggcgagcgccactgaaattcaacagctttacgaaaccaccctgtttaattccaacgaaggcctgattgcctgcttcctcttaaaaatttactccaactatcgcgtaaaacttgcgcatattaaagagcagctcgaagaaattgaagcacagtctacggaaaccaccaaaaatgaatatctcatcgaaatcaaaaatatcaaaaaagaggccgtcatcttagaacacacccttgatacccaacatcaagcgttagaacggctttttaagttagcggaatttaccgataatttggcggacgaagcaatgatttacaacataaaaaccgctgaacgccaaatcacgaagttaattgccatttatcgtgacttaattgaagcgatcagcggtttatttaccgacattatgagtaaccatttgaaccacttgatgaagtatttagattccgccgccctggtcatttcggtcccctcgttaattgccgggctatgggggatgaacaccggcgggctgcctggtgaacacactaaattcggcttcttaatgatgattatcgtcagtttggtgctcgccttgattacttggcgaattttacgttccaaaaagtataacgactagttgtcgtcgttttgcaagagaaatttcaaatcgtcaatttggcgcttaagttccattccgatagtcgtatcggcaatgttgcgccggggaaggtcccggtcgatcacccgtttcaaggttgctgagccagtcgtcgagttatacaactcggccactcccaaaaacggcgtatgggtaacgatttggaacccgtatgaattgttgatcagcgtgtagccggcaattccggtcgccttctgataggccttcgataagccgccgtcaattactaaaatttgaccaccgcccttgattggcgactcgccgttgcccacctttaccggagtgtgtccgttaataatgtaactggagcgctcgtccaacccgaatttatctagaatatagtgcgccgtggaaagccggtcgcgaagcatgaagtacggattatcgccttcgcggtgggtctttttatcgtcaataaagtaacgttcaaacgtggtcatggccgtgcgcccaaaaagcggtgattttttgccaatccagcagtaccacattaagtcggtatcatcattttccgcaaaatccgccttactggtggccgcgcgaatccgctgttcgaaaaaatcgagtaacttccggccggcataacggtgcccccggtattcaaactcgtcaaagtcgccgtcctcggttaacggaatgcaaccgtgatacaacaagttattattgtaaattaggtacatgctcccctttcgcaaaataaagtccatgtgggccttaatttgcggggcatgccgaaatgaataccctaaactttggataacttcctgctcttccgcggtcagttcgtaggggtgttgcggatccaccgtttgaaaacacccgtggcttaaaggataggtccgaccgtcaatttcaactgcgccagtgaccgcttgttgcaaaaacaggcggttttccatttcaaagtcgggttgccgggcgataatctggccctctaatttaaattggataatggttagggcctggtgaactttagacaacaaatccgcgttttgctggttaaattccccagctttcggatagaaaaacggatcggcttcgtaatgttggtcggcaaaggtaaacaacgcccgtaaattgattccatattcccgttccaaatcaaaaatgtagccgtaccgagtcgcaatccggaaaagggttgcgatgcaggcctgcgaaccggcgtaaccgcccagccagaggacgtcgtgattcccccactgaaaatccagggagtgggcgttttccaacagttccaaaacctggttagacttttggccccggtcaaaaacgtcgcccacaatgtgaatgtgatcgatcaccagcttttgaatcgtagcagccaaactttgaacaaaatcttgcgcccgattcaattcaatgaccttattaataatctgggcgtagtacttttgcttgtttttcgggctaccttctacgtacaatagctcttcgataatgtaggcgtacttcttaggcaacgtcttccggacctttgaacgcgagtatttgcttgcacaatattgggtaacctcaatcatccgcggaatgatggtggtataccactgaatcaactcgtcggcacttttaccctgttgcactttttcaatcatgaatttaggataggctaccacaaagtttaattcctttttatcagccgccgccatttcaggaaaacggaggttgattttttcgctaatgatccccgccccggtctttaaaatatggttgagcccatcatactcgccgtgaatatcactgataaaatactcggtccccttcggcaaatttaaaatagcctccaggttgacgatctcggttacaatctcatcttcgttattaaattcttttttcagctcttcaaagtatttttctttatacattggtatatacccttttacgtttaattatttatttgatactttgatgataccacaaaaataagcgcttacaagttcaatttattaaacaccctccccgttatggcaaaattggtaaacagcagttaggggcttaggtttcttctcaaaaataaaaagccggcgacccctactaaccatagcagaatttaatctccattccgttagtgaaggtcttccagcttttttaaagaagctcattattggttgaataactgataaattgccgtaggttcgttagtttgctttaactgcgtaacaaactgttcgtgcatcaataatttagaagttgccgagagatatttcaaatggttaccttgatcctgctccggaattaaaaacgaaattattgtatctacgggctgttgatcaaaggtttgccaagtaatcggtttttgtagcttaacgactagcattgctgaatttttgatgctggcatcttgtgcatgggggatcgcaatgccacgttccataccagtagaaccggctttttcgcgtgctaaatatttctggcaaaccgccttggcatccgtactatacccattttttacggctaaattcgctaaatattttaacagttcgtcacgtgagctaacttcaacgcccgttttaacattcttaacggttaaaatttgcgctagctcttgatcgtccgtggttgcctctgcggttgttggattcgttgcatcacgttccgtagccttagttcggcccgcaactaacgaaagtagaaagcctgaaattagcgctccaatgacaatgaaggccacccaaagaaatggtttattaactaacggcagcacgataaacccaccgtggggagccggaacactaattcttgtcatatacgttaagattgcggcaactgccgaacccaccataaaaattggaatgttaaccaacggattccgcgctgcaaatggaatcgctccttccgtaatgtgcgtggagccaagtaaaaagtttacgtatcccgcgctccgttcattgtcggagtaggcattgcggttgaataatacggcaaaaccggttgccagcggtggtgcaatgcaggctgccgatactcccgccatgaagaagtagtttccttgagcaagtagtgccgtgcccgtcaaataggctgctttattaatgggaccgcccatgtcaaacgcacacatcatcccgataattaatcccaaaattaacggattcgaattttccattcccttcaaaaagctcatcatcccggtattaatgtctttcatcggaattgacatataccacataattgcgccggaaataaaaaccccgataactggaaaaaggaaaatttgtttcaaaccgtccaacgatttaggtaatgccttaaacaagcgttgtagtaagactaccgtgtaacccgctaaaaaaccgccaacgattccgccaagaaatccagttccgttagtataggcaatcatccccgtagcaaaaccaactaccaatccggagcgtttcccaattgcctccgcaatgtaagcacacagtacgggaaccatcagattcattgcaaaaccaccaatggtattcagtaactgcgcaaagctattaaactcgacactcttagggtcagccgagttgattccccagaaaaaggaaattgcggtcaataccccgccggctaccacaagcggcaacatgtgggaaaccccgttcattaaatcaacgtaaatgttgtgccagaaggacccgttagcctcactgctctgggacttaacactagctgggctactggcatggtaaacgggaacgtcgtcatttaaaatactgtcgattaattggtcgggttccttcattcctttggtaacggacacgttgatcaaccgtttgccgtcaaatcgttcaatttgaacgtctttatctgctgcaacaatcacgccgtcagcgccttgaatttcttcatcagtaaatgggttatcggtgccgctttggccgtgagtttctaccttaatggaaacgccccgctttttggcagcttgctccagagcttcctgggccatgtaggtatgggcaattcccgttgggcaaccagttgccgcaataatttggtatttagccattctcgattcctcccttaaccactttaatcgtaatctgtttacttaattcgtcaacgtctgtaaaatcagttaatcctggccgaaaagccgttgagcttcctgccgcgatgctatattttaaattttcatctaatggtttttgttgtttcattccggctaaaaaggtgcctaacatggtgtcccctgaacaggccgtattgactaccgttcctttaggagcatttccgagcaggacggtggttgcgttaactaagagcgcgccttgactacctaacgacagcaatatgttttgggctccccgtgccactagttgttggccgcattcaattaaatctgttaaggttggccgtttagttaacccaaaccacttacttagttcttcatcatttggctttagcaattccggttggtatggtagcgtttccaaaactgccgaataattagtatcgattaccaatttaaaaccttgcttttgggacctttgcgcgatttttactaaaatttgtggttccactccgcaggaaaagcttcctgaaatgaccaaagtgtctgttgcagtcagttttccaatcaatcctaagaattcagtcacctgcgttggtgtaacttggggtcccgcattaacttctttgtactcggttccttctgctagcacccgggtgaagacgttaatccgcgttggttgatccgtatgcacaaaatgattttcaatgccccgctcacgcaacgtttcttcgataaatgcgttggtaaaacctcctccaatgcctagcgcctgattttcaatgcccaacatctttaaaatgaaagaaacgtttacgccctttccgttggctagaatatcatagctgttcgttcggttaaccttgctcggttttaattcatcagtttcaataaataagtcaattgctggattcaaagtacatgtgtaaatcatttaaggcacctcttctttctgctaccttaattgtaggcgccatcgcgttgtaaatgttttcaaaaaaatctttttctgtggtattcttgaaaaagaatttacatttaggggcggctaatttgaaacaacaaaaattaagtaattcggaaaaatacgcgtggcaatttatccaagatcacctagaaagtatcccggtactttccatcgttgcgcttggtcagcaggcaaacgtctctacagcaaccattattcggacccttcgcaagcggggcttcaagggttacagcgattttaaacaccatctagtcgaagagaaccaagattcctacaccaatcttgctcgcgccgattctgatattcgcagcgccatcatgaaaaatgaacacgaagtcaccaataccattaaaatgattaagattgctgacgttgaaaaagcggtgcagcaaattcgacgtgcccaaaccatttacatttttgcccggggcttttctgaactaatcgctgaagaacttttagtaaaacttcagttattaaagaaaaactgtcagcttagcgacgatcccaacattattcaaaccctagcaaccgatattcgtcctggcaatttagtaattattatttcacttaatggagaaactcccgaactagtagaggctgctcgccgtatatcacaaaaccgtgcccccattcttttgatcaccaccaacggcactagtagcattggaaaatacgcctctttaattttatgtggttttaagtccgaaactacttactttccggcgtatgaagtgcactcccgcttgcctttacaagtaattactcgagttctgctagattcatacgtaattcgcactaaaaaataacccctcccatccgcaacttcattgtttgcgaacggcaaggggttatattatttttacgtaactttactaaatctgatccatttttactactgctaagccagctaccgtggcaactaaaacgatggcgaggtaaaccacgttttgtgcactgccgaccgggttagcagaaaaggccatcccgtaaagtacgggtcctaaagccgcgatgaggtaaccaccagcttgagacatgccggatagttgtgctgtttgatatggcgaagccgtcttcatggcaaacatggtcatcacgaaaacaaagaagaggtttaccgaataaccaatcaacaaggcttcaattaaccaaaaccaagtagcggcggtattttgcacgaagagcattccggctgccccgaggcccacgatccctgcggatagaatcaacccaacctgagtttgccgactcacccgggtcaaggtttggggtaaaaataccgagactggtaagccgatcaacgaaaagcacgccatgattgctccaatgatgcccgagccaacgtgatggtaggccattaacgaaggcatccacgccgtaaaagtgtacatcattaccgattgacaaccgaacaccaatagaaagcaccacgcccgcttattttgccaaatcaccgttttagttggggcttgattgtccgtcggcgttggcacccgtccgtccatctcttctggcaaatggggcacgatcaacccccacgttagcaaggccagtaatggcaccaccgttagaatcaataacatcgtccaccatccggtcaatttaatgattggcgcggtaatcaagttaaaaattgcgctacccatcatcattgaaaaagtgtagagcgtggtgtataacccaatccgttgcggaaaataggccgccacaaacgacggcataaaaacgtttaggtaggcgattgccaccccgattaaaatcgttccgccaatcatcgtgggcatcgttacaaccattcgtagcgctgatccaagcactaaaatggctaacgctagcaatagtgaccgtttaaagcccatccgttttaaaatttgtgaagcaaaatttgaaaacaccatgaacatcactaatggcaaagtggttaaaatccctaagcttccctgggccactcgcaaactttgcgctaaattgcccaaaatcaagggaatcgtagtaattggggtgcgcatcatcgaccccaccaaaatcaccactaaaaccatggcaaaaatgcctattttactttttctccagttcatgcgtacccttcctcaccttaaataatcatagttttattgtaccagagtattttgggattcttcggaagtcctttagttttgtctaatcagctccaaggaagcgctcacaaaaaaacgagaccggaatttccgaatctcgtttttggctttaactaacgctgattttagaagggatccttaaccggaaattcttctaactggcgtttaatcattgcccgatgcaattcttcttgccgttcaatttctgccttttgctcggcagttaatttttcttcatcgacattgcaatccattttaatggcctcctctaatcttgaatcgggcgaacctgaaccaatggccccttaacccccggcaagattcctgctttgaccttatcagtccgcgtcgcgtgcgccaactggaatttatttttcttcactagcatggggttatgggttttaaatgaacttgggagagattcattcgtaccattcaatacaaccaccaccgctttaaatcctgctggcgtaacctcaatggggctataatgcaacgtgtcactaaacatttcaaagacggtcccttgcggaatgtagaaaatttgcgcgtcgtcaacggcgtggaattcgtaattctgtaaatctcgtcgctttcctaacaccataatcacgtcggtaaaggtgatgttcacttcgctaccttggtgaaattcaacggctgaaaaggcatcacagtggcccacacactggcctgctgaaagtgccattccgccaaaaacattcccgctgatttcatggatcacgctcatttgttcaattgcaggatttttcggtacgtactggtttgcagcggtaactgccaccctagccatgtaatcgttaatttccgttaaatcaaattgcttatatacgattccataatcccgaaattgttcgtcacccacctgataaatcgttaactgagagttcgccttttggattttttcatagttcgtcatcttctgggtcttttcaaattatttttgtaccttttcaaaccaaggggtcgcactctttgccaaaaccttgttcaagtcttcaatgttcttcttaccttgggtttgcagccacttgcgaccaacttcttcgctttcgccagcaaatggttcaattgcaccgcgccaagttgcccggccacaaaggaccccattgaattttgaacccgcatcgtgcgcaaattggagttcttcttggaataattctgcagaaacaccagcactcaagaagatgaatggtaagtcggtagcgtcgctttgttccttgtagtacttcgcagcttcttccttgctgtaaactacgtcggcgtcgttttccgcaaaaccttctacgtaagcttggttaactggtacttccagtttcaaaacgtcgacgccgtattcgggtttagaaaattccttagtcatttcgataaccttgtgcggtttgaccttagcgtattccttaccctttacgtcatcattgttagcatcgtacgaaactagttccaggaagaacggaatgtcttcagccttgcattcgttgccgagccgttgaatgaaggcatgcttgcgttcgttgatttcttcaccttcgtcaacatcgtaatacaacaagaatttgatggcgtccgcacctaattccttaagtttacgtactgaccattgatcaaggatgtctgggaaacggcctggttcagttgcgtcataaccagtcttttcataagctgttagtaggccagcgttttcgtcgcgaactcgtgctgcgggaatgccgtattctgggtcaagcaaaattccgcttgcgtatggagtcaattcggaagaaatcgccaccttaaagtcttcgatttctttttggctagcttcgtgtccgcttgccgcgctaatcatctttttcaacgaaccgcgttggtcgattgccaaagcgctgattacgccgttttcatctgataaagccttcagtccccgtagttttccttctgtcaatgttttcatagtgtccaacttccccttttcgtttaaaaaaatatttttgaatgccctttcaggtaccgcttacaattttaacaaaaatttgcacaaattgataatcggcctaattaatcgtggtaaaatccttcagcccacttttcgttttcttcgccaaagaagtgtggattatccttttgatctgggttgggtgtagcaatgtgatcaattttgtcgatcaacttcttgttttcttcggtttccttgtattctgaatccaagaacaacttaataatgtcttcgcagaggtgttcgccaacggttgcgccgccaaaaccaattacgttagcgttaagttcttccttagcgtaacgtgcggcaactaggttagaaactaacgcagcccggacaccttcgttcttatcggccgcggtactaatcccgattccggttccacaaagtaccacgccaaggtctgcacgaccatccgccacgtcttcagcaacccgtttcccgtaaattgggtagtgggtccgggtggtgtcgtaagttccttcatcaattacttcgtgacctaaggatttcaagaaatttgataattgaatttttacgtctgtaacgatatggtcgtttccaattgaaataatcattctatgcttcctccctaattaaatcattttgttaagcatgtctaagcggatttgatgacgacccccggcatactcagtatctaggtaatattgcacaatgttgtaagccaatttttcaccaacgacgccggcaccgatggcaatggctttggcaccgttatgcatagcggtcatgtgggcggtgttttcttcgactacgttagccgtgaccatgcccttgaccttgttgctagccattgctgaaccaaccccgtattcgtcaaacatgatagccttttcaattttgtcgttcaaaaccttatcagtaacggctaaggaagagtctacgaagtccgcttggggagtttcactaacgtcaaccacttcgtaatcatgttctttaaggtaattctttaccttttccttcaagtcaaaacctgctttatctgcacctactacaactttcatgttcactgctccttttcttattcaatctttttagcaacgtggacggcggtaatttgctggtaacgtcgtaagattgctggtttaacgcccgcatcggtaatcaaaccgttaacgttacttaaatcatagaaattatagaaatcatcgtgatctaacttatggtggtcagccacaatatacttattctgcgattgctccaaagcaacccgttgcgacgcgccttcatcggtatctgcattcatcacgcttgtgttcgagattccgttaacccccacaaatgccttatgcattttaatgttgcgtaaaaattcttccgctaaaattcccacaaacgcaccgctccggcgtcggtaggttcccccaactaagcaaaggtcaaagtcgtgctcatctgaaaaacgttgaaaaactggcaaactgttggtcacgattcgtaaatcatcgatttccaaatatttggaaaccaattcattcgtcgaccccgggccaagaaaaacagtttcgttaggtttaatcatacttgccactgctttagcgatttcatttttttcagctaaatgaattttacgtttttgaatatatgagggttcggtttgcgacactaagttaacgctttgagccccgccgaaaactcgcacaattttttcctgcttctcgagttcgtcgaggtcccgccgaatagtcattgacgaaactgacagcttatcgaccaaatcgttaaccgtgatcgttcctttactattaactgcgttcaaaattttcatcattcgttcattttttagcactcgcacccctccttttcactttttaaatgtttgtttttgttcatttgtgttacaaactaagaataatatttgcattcccgaatgtcaacgctttaattaatccaaacccaacccaaaaaactggttgacaatatgaaagcgcttaattagaatgaagctgtaatcaaaaataaacaaaggcaaacataaataaactttaccttgccaatgtttgaaagaggtgatctgtatatgagcgaaacagcaatcgaatctctatttgatccaaagattgtctatgttagttcaggtacaaccagacaggccgtttttaaggaagtcgccgacgacttagttgaaaagggatacgttaaggataactttctcgacaatctgaatagcagagaagatgcttatccgacgggcatggatttatcggtggtgggatcccaatatccaaacgtcgccattcctcatacggaagccaactttgtttataagcgccggattgttcccgtaaagctcgcacatcccgtcgagtttcataacatgatcaatcccacgcaaaccatgaccgtccgctttttattcatgattttgaataacgacccggaaggtcaagctaacgtgcttgctgaaatcatggagtttttgactcacaccccgtgggatagcttgcaacacctgtttgcaagtgattccccggaagagatctttgatttcttgtcgactaactttgatgaaaaataattaaattacttatgtggaggtatttattatgattaaaatgttaactgcttgtggtgctggtgttaattcaagtcatcaaattaaggatgcggtcgaagaagaaatgaagaaccgtggttacgacgtttctgttgacgcagaaatgatcaaagacgttactcctgaaaagatggaaggcgttcaaattttcttaccaatcaaccatcctgaccttggctttgacattgatattcctgaaatcgatgctggggcaattctttaccggatgcccgcaatggctaaacctgtttacgaccaaatcgaagcagaaatcaagaaaatccaaggctaattaactgcttaaacaaaggggaatccccaattggctcggattccccttatttaataccattaaagtaagcgccttcattgctttagacggcgttccccatggctgctcattttaagcggtcattaatcaatctggtttcaattttataaatcataactacaactaaataaaggagtgagattatatgaatggaatcattcattttgccaacctgattttcaagccaatcattgacttgggggctgccccaattatgctaattgttttaactttattggcttgggcattaggcgttaagttttccaaagccttggaaggcggtattaagctcgcgattgctttaaccgggattagtgccattattaatattttaaccaccgcttaccaagctcctttggccgcttttgttaagtcgacagggattaatctgtcggttaccgacgttggttgggctccattggctaccatcacctggggctcgccatacaccctgttcttcttgcttttgatggtaattttgaacttgattatgttggctttgaaatggaccaacactttggacgtcgacgtgtttgacatctggcacatttcatttacggcattgatggcaatgtactttggtgccaatttattaattgcaattattttgattttaattatcggtattctaaagattatcaactccgacttaatgaagcccacgtttaacgatttattaaacgcgccagatgataacccaatgactactacccatttaaactacatgatgaacccgataatcatgctgttcgacaagatttttgacaaaattttcccatggttagataagtacgactttgactctgctgaattaaacaaacggattggattctggggcagccactttgccattggttgctacctgggggtctttatcggtttagttgctcggcaagatccaaaagaaattttgactttagcctttaccggcggggtctgcttgcagttattctcccaaattggagcttggttcatcgctgctgttgaaccactttcccaaggggttactgacttagctaacaagcaccttcacggacggaagttaaacattggtttggactggccatttatcgcaggacgtgctgaaatctgggcagctgctaacgttttagcaccagtgatgttgcttgaaaccttagtattgcctggcaaccacatccttccacttggtggaatcatcgcgatgggagttactcccgcactgttggtggttacccgcggtaagattattcggatgatcgtcatcggggccattgaaatgccaatcttcctttgggccggtactttaagtgctccattcattaccaacgttgctaaacaagtgggggctttcccagcaggtttgagcgctggtactaagattgctgaatcaaccaaggaaggaccaatcgaacaattcttagcttacttagttggtaaagcttcgactggtgaaatcaccttcatgatttacgcgttgttagcactcgctgcttacgtcctcctcttctggtggtacgcaaaacaaatgaagaaacgcaacggtgcttacgctgctgaaaaagccgctaacgcaaaataatttttaaccgaaaggaacctgcattatgataaaaccagagcatcaaactaaaatgtccagaatcattgcttgggccatggtggtggtcgccgcatctacggttcctgcccttttcggtcgtaacgtttggacctttggttttcaagcgttgatgtgcgtgatcgccttcacccaaatctcaaagaaacatcccgctgctcctaaaaagtagccggatagaatttcccccttttaattagattagcaaacccgtcaagttggtaaggccaacctggcgggtttttgctaactactctattatcgtggacgtcggtagacaaaccagcctacgcaagctaccaaccctaacgtcactaaaccaaacttaattactagttggtgatcatcgccggctaaaaccgtgtctaaccgcagcggaaggggctgacgagcatcgtcatctcgcaaactcactccacggatttctcctagtctgcttccggtccccgaagcctgctttacgggcgtcttaccgttatttttttcgttgaggttgaccccggttaactgcgcttggtgtttaaaacaccgggccattgaattagttgcccttgtttcaaaatcaatcaagttagcaccatccaagtcacccagcgccaccgcaaaccgtagttggctatactgggtaattcgttttggcgagcgacttgccaacactttaaacttgcgaccgctccgatcaaatttaacctttttgaccctgatcgaatccgggactaactgctggtttaccccgatcaagtccgtgtacgttacttgtcggagcggttgctttgcataattaaggcgtactcgccaatgaattaattgggggtccttagtatcataccaaccccatgaatacaccgtttctcgggaattaggtccctgatgcggtaaaattttatatttttcggttcgtaaacgtggccaactgacagctacggtggaagcgggtttgacccggtcgtagtcccataaaagtcctaatttaaagttgccgtagatgccaccgtcatgttgcgtaacgtagcgcgctaaccgcaccgtgattttaccgctcccacgttgtgcatctacccgtccaatcacttgcccatgccggtctttcaggttgaattgggcgttactaaccagtcttaaatttcgggggactttaaaagtgagttggtcttgcgccttgaccggtacgttggcaggaattttaaattcccattttccaaccagcttgtcgtacaaaccaaaactagtacgatcgtcgtgttgcgcatctcccaaactcacgttagtaataaattggtcgccccaatcagtggatgagtacgcaatggtttgattgctttcccaaaaataaataattgcgatcactaatccaagtagccatcttttcctcacactaatctccttttaaaacttaactattcccaagttgggtcaaaatgcgtccgggcccacatactccgtaggatggttcccaccgctaaaatagcaaagaatatcgaaacgatggccaacccatgatacaggccgttccagctaaatccaatccataacatcccgtttttttgtacgttggtatacatttttatgcctcctttgattgatcagtatttaagtggttccaagtccccgttgacccctggagcaattgaagcagcgcacctaagtaagccaattgtaaaaacaagctatacattagttccggcagcatcatgagggcaaaaaacttggcctggaaatcttggtcccaaatggtcaccacccgctcggtagcaaaaatcacgccaattacgaaccacagcaaactaaaaatcattaaattttcgagcatcaggtacgtggtgaacacaatcaatcctaaaaaagcgaacaccgaaattaataacatcaactgttgaaaaacatacggcaacatcattttgttccaacgtcggcgggtcacctgctgaagcgcccctaaataccagcggcgccgttgtaaatatagcaagcgccacgtcggcataatttcagtcgtgcaataacacgacaatggcgaaatcattttggcccccgctgcttttaaatctagcgttagggcaaaatcttcggtaatcgaatcctcgcggtaaaaggtcccaatttgttgtcgaaccttttgcagcgtttctgctcggatcaacgacgcggtcccggttaagacaaaaactttcttactacggcgaacttgattggcgtagcgataccactccaactgttggcaaaactcaatcagcttattgcggttagccgttccgtaaaagacggagccaaccgcatcataatctccctgggcaattactcgcttagcgtgttcaatccagtcttccgtaatcacggtatctgcatcacagataaacaaatactggtccggtcgctgccaatctacgtaattctccagcgcttggttcagcgcccccgcctttcgaccttcgttttgcatagtttcaaatgcgcgggcccctgcctgttgagcgcgttggtatgtatcatcatcacaacggtcacaaaccacaattactttatcaaccttttttttagcgctcggaccgcgcgtttaatatttccagcttcgttgtgcgccggaacaattgccgttacgtacataatttttcatttctcccccaagtaaaagtatccgcagctaccctcgttaatatgaattcccgcccaaataaggggtctggttaattaacgaataaatgctgtttgctaatttcatcgtggtttctcgaccacgccggttacctaacaaaacaaccgccgttcccgccgagcgattgaaaataatcgacggctcgtatccacgtaaaatcccatgtccgcggtaatatagccgattttgataaactcccccagcatagacgctttgggtagaagtcttaaaaagttgcttaaccaccttaagcgggatgatctgaccgttcaccagtgccgcaaaataccggtacaggtcgcctgcggtcataaaaaagcttccggtaccaacctcgttacgataaatgtaagccgggttaggatatgcccgaccgtttttgtggtaactttttgccacgtgcggatttttaaaatcgggcatgctcatgattttaatgggccgccgtaatttaatcagctgttggaaactgtcctgatagtttaggtgagtaagttgggtaatcacacctaccaataagtgaaaattcaccgcgtcataatcccagccttttcgcgggtccaccgccaaatggtgcacgtaatagtttgtaagctgtttttcgtttagtgcccgttccggatcactacttgcttccaatcccgaagtcatcgttaacatatcgcggatggtaatatttttagcattaggaattgtcggataaaaacgggctagctttgtatcaaaagacaactttcctaactgaaccaatttcgccaccatgattgaagtcatactcttttcaatcgaggcaatgttatataacgtttttacatcgttagcatgggtggcatcttgcttaccataacccttatgtaacaacactttatgatctttaacgattaaagccgttccgctaaaacgatttttcgttaaagtatagtccacgttggtaaccacgtcgccacgggcttttaccacgtaacgagtggcccagcgatcactgaagtaggtgtcgtgtaccatttttgctacaaacagtacttgtaacccaattattatccaaaaccaatatcgctttttaattgcagcgcgaccacctttctaaattaaaatgggtagggatttagcgaaagccggcttcgcttttagttcttgaactggccagtgaggggctatcctttttgacctgaataattgccatataaacacgcagaggccagaaaaaacgattagtttcttccagcctcccgttgtccccatatcctaagctgctaggatattcaaaatgatcccccctgtactaattcaacgattagtactttttcatcatataatccgaccccttgacagtaaaggctcctgacgtttcacattttgaaattgatttgaaaaacttgagagaatcggtcactaccgggtatcaacacggttccttttttagccaaaattagaataatatttaaagcaaaggccgggtagtttgtgaggaataactaaaaatcgaccattatgctcgaatctggcataatgatcgattagggttaaacaaactgacttttggcatacgttttggctctattaaagccaatatagcaaacgatttattaactctttcagccttttcagttcaaaaatctaattttttagcaacgtgctcctggacccagttccctccggttaataaaatcccgccgccaatcgcttaaatcgcgattaacggcgagacttcctactgtagcatagtcgaaacgtgttttggaatccaactctctccggttaacaaaattatggctccaatcgtctaaaccgcgactggagccataatcctgttatcctcgagagctacccggattccaaaacactctgattcttaatcctcacaatcatatctcccaactgctcccaatccgccgctaacggtggcgactcccatatcatttgttcgcaatctagttccgcaaacgattggtccgagaggaagatatccgtttcttccgttagttccatcataatttcaatatttagcagtgcaaactgctgcaactgcgccacgatatacttcgtaaagattggtccattcgaaaaatccaccgtaatcttaaccgttcggcttaaaaattttaccggtaaatgttccaataaaatcaacatgtacgtgtagtacaactgggtcaacacgtcctgatcgatatatagctggcggcgtttagccacctcgcccaacaactgctttaccaccgcgtcaattgcgggataagtttcgttaaaaaagggcatttttgtgggatcgacgaacgtttcactaaagtaaaacggcgagaacacctttgcattcgtttgagttaaggatcgtttaattcggccaatcgccttttccaaacttgcgtccgcaaaagtgctgtataaaagttccgtttgactatccaccaaatcctgtaaacattcttgtagctgcggtccacaacattgatcaattgaaaaatccagcagctcgtttactcgacaataaatcgttaagtactgtttttcccgacgcaaatcctcgtcctccagcccccaaaactggttaaggggaccaaaatcaggaccatcgtcatcagcagccaccggacttaaatcggctaactctgtaagtacgtgcccttgtcgaattctttgagcttgtacaaaagcaaaattaaccagtcgcttccgttcggtgtatttaagacacatcccacaatccgtacaaatttgttccaaaacggttggtatttccattcagtattcaccagggagcccatcaattccgttaaaaaaatggtgaatcacactaaacaatacctgtcgcaaccttgcttccgtcaacgaacgatagttgaaaatttcttcggtgaagagttgccggattcccataatattgcgataataagttgctcggcttatcccaaaacgtttcgtgaattgggcttgagtcccgtaaattcctaattgggaattaataaaaacatttagacggatcgaccttagcgccatttcttccaaaagctgtttaagcaatgacgtcgtcaagccatacatggcaatgatccccttcccatcgtaggccaagtcgatgtttttcaggttaagtgacgcaacggtatctttcagcaaatcaaaggccattagcacttggtgacggctaacgcctaattcactttgtagatagctaattgatagcttcttttctggatcgtggatgtaaagttcggccatttggagcaccaattgttgttcgtcgtccaataaacggttaaacttttcgatcataaataaaaactccttaagatgatttgttgaagatatttttaaagatccaactctaaaaatatgtctggagggttcatcatcttgggaacaaatcactaccaacggttctataattacggtcgtaaatggttcatcactagcttagtcggtgtgaccattggactaaacgttctgttgtcccccatttccgtagctgctagtgatcaagtatccaaatcaacttatccggcatcatctcctcaaattgcaccgcaagaggccgcaagccggccgccgaggttagattactggggatcatctgctagtgcgatcgcctcatcatcagccgatccgcaccattatttttggggaaataagcaccatcaccatcattggcatcaccattgccatgcaacggttagcgtacggtacgttgaccagtccggccatttgctaggaaccgggcaagcgtactgtccgcacggcccctacgttggcgagccttacgttagtcagccccggtccattaaaaattaccggctagtcggtactgcgcctgatagtcttccaactcggggaagacttaacaaagatggcgacaacggtatggttacttatatttacgctccaatataccacttcaaagctaaaactatcaacgaaactatacattatgtcgataaaaatggccaaacggttgcgccaacccacgtagcccagcccattacctttgtgaccgttgataatttagctgaacatgtgacaaaaaactatttttcgaatacctcgactgattttcaaatggatgatcaaggcaatcctcgggattctgaaaattggcatagtggtacgcaagctacttttaccgaggtacccgacccgttgccccatggttaccaactaacggatccagctaaggatgcggtaccggccacgcccgtaactcctgctagtaccgacttaaacatcacggtccgttaccaattaaaaaagaaaacggccgtaatccggtggattgacgaccggacgggaaaaatagtttcctctaaaacggtcaacgtggatgttaagcatccccaggccaatttaactgagaccttcgatcatcaagactatcgcttagtcagcagtgatttgccgcagggatcgctcacttttgatgaaattaaggaatctggtcacctttacgaagttcatttacgttctcaaacgccaccagtccttcctgcggaggttaaacctactccttcggaaatgtcgtcatcgtcccagcctgtaacgccacctgctttggcgccggcggagcagcgtcctgcgctaccagtcagccccttacaacgggcaacgccggcgattcaaccagcggtcgccgggcgtcatccgcagcagctaagtaagtcgctttctagtagctcaagtcgcccgcagtctgctcaatcacaaccacgttatccggttcctacgggcacgattccgctggcggtgaatgatcaacagcctgctccggtgccagatttacttgcccgtttgaatttaaaatggtatttcccaagggatcaccatcccgtactggctttcgatgattggaataaccacgtccaaaaaataattaagttaaacggagatacaaaaagccacactcagctgggccaggtgtggtataaaatgtcgggtaggttggtaatggggcaaagagtgcggaagagcccgggtagtctttgaggataacagaatttcagcattaatcgcggttttagcgattgatgctgaaatttagttatccggagaagactggggtctggagcacgtttcggctacgttgcagatcaaatccaccgttaccccggtcatataaatgcaggtaccagaaataattatccttccgtaatttatttctttaaaaatgccaaaaaagttttaaaataaaactggagttggacattaagaatccaactccagttttttagctatttttgaaacccgtttacgtaatttaaccggtttgctatagctactctgcaattatcccccaataaaagcaaagttcttctgtatgcgtctactccccactaagtgggacaaaggtattttaaaaattatttgtttaagtttactacgaccccttggtgaatgcattctcggccaacaatctttaaaacttgattgaggcactattgcgattcgaacttcggagtccggttttccataaaatcaaagatattcactaccgttgcttgccacatccgttttttcaccggaattgactgccaaaacattggtttatcggcaagtacttcgttaaaaatatctgtcaaagctgctgccgtttgccgcaatttttgccgacttttgtaaatttcaaaatcgacaactttgttatttacttggctattttccctgtgaaaaatttgtggtcccatgtgaattatcccccttaaaagctattacctgtaactaatgctaccatcactttaaactttatttatacctttgattagttaaaacttaacttgtgttgttataatatactttaaaattcaaaagtgcaagcgttttatagctccatttcacaaaaagtatcaatttcacaaactttcccgctcaaaatattaatttaccggtcttaaccatcaagaccctttagcgattcacaagcaaacttttcttgcgtatttcatttttttacttagtataggcgtctattttgaaatctcgtttcaaaatagctgacataacaaaaaaacgtggccaatttcgtaaagaaaatggtcacgtatttgggggacattatgttagtttattctttataaagttaagtttaaaagtagtcactacgttgctaacctgccaaacactgcgccagtttcttagcaactagccacccttaacttcatcacagaaataattttgtgtgttcagtcactgtctcctgactgcctcaccaacttattggtgttggtgcttatacttagctcttctttcttggttgattttccttaactctcgctgtgcttgagccaaggtcatttgtgggccgcaacctagaacttcttccattccttcacgggtaaccaaccaactatttccaaacttgcgaatggttccttcaggaaatacttttgtcccgttaatttttaaatggcgaacaaaattttgcgactttccccacatcattgccgcttcgctggcactatatacctctaattcgcgcaaatcgatgcccataaaaataactcccttaattaaatcgttgctacattgttgttttcgaccatagctcggccacatttttaaaccaggggttgaaatggatcaattgattatctaaaccacgcagttaaaccatcatctaatatcataatttttcgcgccgtttggtaaaccccgtctacattaggtagtatatatcatcacccggaagtaaatttctcataatttttgttttctagaaaaaatggtcactcggcaccattttccgtctatgcatcagtttacctagtcgaatttaaactttttgagattattaactaatttaacttaatttgtacataaagtaatagttataaaacttattaattcgacatgtactcaaagatttcccgtcccgcgtaaataatctagctaaccctaatccatccccgtttttcgctaaacattgcaatttgtatcgcagatatgtcttatatgtcagacaaaattaacaccataaagtttaaaaattactaccaactgtttttaatgccaaattcaattgtgacaacgttcaacaagcggtattattactaatagaagagagctaggaggtatttatggatccaatactattaatggataaaaaagatcaattatcttttgaaattttatccttaatcaaccgtgccgcggacgcacctgtcaacatggatcacgttgcggacaagctaggagtaagctcgtacaaattaaatgctgcgttaagtaccattaacactgatttacgcgaactcgctccccagcaaaacatccacattaacgaattacaaaaggggctgtggcaagcacaaaacctttccagtttagtaatcaataagatccgattggtgtacgtattacgttctcccctcttacctgtgtttgagtatttaatgttttatgaaaacctaaagactcctaaccagtacttacaagacactccaattagccgatcagtattttaccgacaaattaaaatgttgaataaaatcatcgctaattattctaaggacaaccctaaaaatggaaaagtgggagaagaatttcatcagcggttacttttatttcagttttactatagcctttacaatggactcgactcgccatttcctgaactaagtgacctagttgaccaaatcgttcaagcatgccaaccttatttcacgcatcccttacgattaagtcaaaaatttaaattgtcaatctttttgcgaatctggattcttcgacatcgtaatcaaaattacaacgaaaccttaaccgttgatgttgacgaaagtaacgaccaatatcagcagttgtctcaacgtttacaacgcgttctcggccgtcattttaatctagataggtatgaaatgagttatttctacggctttttgcttgcgaagggctacattaccaactctagcaaccgggttatatcaaataactttcctttagcaacccagttaactaacagtcttattcagtggctaaaggactaccccattacgtcaactttggacgaaaacaccgaagcgtcccttcgccacgatttgattaacgttaaccttcaattaacttcattttatattgagccctctactttcgtacgggaaaattccatcaagtttttcgggaaaacttacccatcgtttgatatcctaattcatcgatttttacagagtattcagactgaacacgagattaccctggacgctcctaagtgggttaacctttactacggttatatgtttgcgttaattaataatatccccgcccgtttgttaaaagaacgagtttacgtggcggttgatttttctcaaggagatttatataccgaatatgtaatcaactctttagacgcatttcatcatgcaaatattattattgagacaaacatctctaataatacggatatttttgtgtccgatatttattcgcaatctgtaaagcaacctcaattaacttgggaagaccctcctacaccagaagactggactaatttaggggacatcatcgaaaatgttcgggctaaaaaagcttttgcattatttaaccaaccaatttactaatgattaataagattaaggagaaatcaaagaatgtctaataaaaattcaagtaaaaagttcacaactcttttgcggtcgacatttgccttttccttagctaccatggggatcgttagcgcccctctgcttaaaaacacggttttacactgccgattaccattggcagaattaatcgctcatgctgatgaaacccctgacttaagctccatttactatgacgacgatacaaatacgttcaccagcagagataaaagttggtcagtgcaagttaatggtaggatttactctttgttaattaatcatttgggaagctatcgctctgtcactcccgatactgaaggggtaatgctgtttaagctggactccccgccggtcaacgcatcctatactttgtccgttggcgaccaagttatcaatacgggagctatctatccgattaatttaaacgggcatacttactatggagctaccctttccaaaacgattattcaaaaattagtccacgaagtagtgcgcacgaaaacttccgggcgtattacatttacaaatatccacggagtacttcctatttctgactttccaatggacgtaaatacgactttaaacgtttcgttgccagcagcagagtattatactgacgaccaaacccttgctgatcacgttgctggattgaaactcagtctaacggattcagacggaaaagtagtcgacagagtccccattgaaaaagattggattgaaaccaaaaaggattccaatttaccggggacttaccaatacactttaaacaacctcggtatccaagcgttacggaaaaagttaagcgatatgggcggagattactgggtttaccaccagcactatacgttgggcgacgtcggaaccggaaaagttaccgtactacctaaaaatccgacggaagtaactgccacagttagttacgtagacgccactactggtaaaacggtctcgaccgataaaatcaggggctttattaacgatgtgggaatttatcaagttcgcttgcctaagggatatcaattagctacgggacagcttcaaaaaatcaaatataggcttgctgccagccgttcggacaacctgaccgttaaggtaatccaagcctcggatgattcatcagattcaggagataattcatctagcggcgatgaccattcttcgtcggataacggttcatccggcgacgaccattcttcgtcagataacggttcatccggtgacgaccattcttcgtcagataacggttcatctggtgacgaccactcttcgtcagataatagttcatccggtgacgaccattcttcaaaagataatggttcatccggtgacgaccactcttcttcggataacggttcgtccagtgacgaccactcttcgtcagataatagttcatccggtgacgaccattcttcgtcagataatagttcatccggtgacgaccattcttcaaaagataatggttctggtaaggatgaccaccaaagtgaccattctgatgaacctggttcagctagctctagtaacggtaaggcttcgtcgaacaattccgcggattcttcgagttccgcggctagccatcatcattcaagtaaccattctgaccatcaaggaagttcacggaaaccttcgcacggaacgtcatctagttcccataaaacggcttctgcttctccaaaacgaggcacggtaaccattgcgttcgttgatggaaatggtcacgtggttgaccaacaaatttacagtggttggcaaaatacgcgggttccttttgaactttcggaccacatcttaggtttcttgcggcatggctacgatttagtttcgccaggaacgccactcagccaactaaaatttggcgccggcaacgctacttatcaggttggattacaaaaacgggatacacctatatttacgaacgcgttagccgctagcaaatctgcggatcaatcgaccgctaatcagcaacctgctaaaaaagctaaccaacgttctcattctaaagatagcgaccaccccgttttagtagaagagttaacccaacaatctcggctacaggaaaatctagctaagcaacacttttccgcaaaacataatctggttgatccacgattacaatcacctttagcgccgcctgacgatgctgcgagtaacttctttagcggctcccacggtggtggcggtggcggaaacggtgacgaaattgatcctgacctaggggccttcttcactgcattagctggcaaagttaattttacgcaacaaacctagttttgctgggcatttttcagcaacctaaagtaaaaactctaagcattaaatttgtaaaacatccccccctatcctttatattggcatcacaccaaagaataggggggaattttatgtttcgacaccaaaaagaattacaatttgaagctaagcctactcaacctgatccaacggttgccaagtatttacaagaattaattggcggtcaatatggagaaatgagcgtggccatgcagtacctcttccagggctggagttgccgcggagaagctaagtataaggacatgatcctcgacattgctaccgaagaaattggacacgtagaaatgttagctactatggtagcgcgtctactagaagatgcacctgtcgaagaccaacaggcggcaatggaacaagatcccgtagttggggcagtgattgccggtatgaatccacaacatgcgattgtagcagggttaggaccgcgtccagctgatagtgtagggaatccatggagcggagcatacatcatttctagtggcaatttacttgctgacttccgcgccaaccttaatgcagaatcacaaggccgtttgcaagcggcacggatttacgaaatggtcgacgatccaggggtgaaagatctcttagccgtacttcttgcccgggatagctaccaccaaaatcaatgggcggcagcaatcaaagaactagaggaacaagttggaacgattctggtgccaagcgatttcccacgtgaaaaagagcgtaaggacattgcctacgacttctacaacttctctaagggagatgaaagtagccaaggtgcttgggcacatggtgaagctcttgatggcgaaggcgaatacaagtggcaggcagagcctaaggcggaaggtcaagctcctgacttaaaacctgttaaccctaaaatgtatggttcttaaacaaaaataagaatccaccaccttttttcatttaaaaatcccaaaagtcctagttacccaggttacgtaaaaccggataactaggacttttatttatccttaaaactaattattagtattttctgcgataatctttaacgccttttgaccaacttttcgccgccgtttggaaatgctctgggggctcaccccctctcgttgggcgatttctcggcccgataattgcttcacgtaccggtaatacaaaaaacgtttttccggaggcgtacaaattgcgtaaacccgttgaaataagtcgtcggctaacacctgttgctcacgggaggaacagcggtattgccgcggaaggttagtcacgttcgtggacagttcggcagtttgccagtttttaaccatcgtctggcgtttcaataaattaagtgtccgccaatagattgcttggtaggcaaacacccgaaactcctttaagtcacttgccggattttggggaaagcggacgtacgcgcgggcgtaggttagccgtgcttcctgtaaaaaatcttcaaaatccggttgatacgggcgaatgtttagtttctttagtactccaaacactattttttggtttccgttagttaataagtggtctaatcctgcttttaaagtgcgattttttggtaacatagcttgaatctcctaaagtaaaagatccaagggcccttggtcactgtttataatacgtaaccgactttgcaaatataatgggacacttttagttctaaaactgcagttttcgctcaaaaaagtgtagtttgccgttaaaatgagattaccattaaaaaatcgcaaattaatgagaccaaaaaacggaaactcgaatttcatttctcgaaatcaagtttccgtttggtataaattataaagtttttaaaaattagtcgatctacagcatctttttaaaccttatgcgggccgtcgacaattttggcttcataaaagtcagccgcatagccaaaacggtcttggtatttttgccctaccgtttttactaactcgtcgacttgatccttttcgattagggcaattgcgcacccgccaaaaccgccgccgatcatgcgagctccaagtactcccggtgattgccaagcttcatctacaagcatatctaactccggaacactgacttcgtagtcgaattgtaaagagacgtgtgaagcactcaccaaccgcccgaagagctttaggtcgccttgtttgagggcttcccgggcttcgatagttcgctgattttcaaaaaccgcgtgacgggcccgcttaatcaacgttttgtcgttaattaggtaggcgtactggtcgaacgcatccttagttaattcacctagtgcgttaatgtttagtttggtttgcaaccgccgcaacgcttcttcacattccgcacggcgggtattgtactcggaattaactaattcatcggtttattggtattcatgatcaaaattacgttattattcaaatctaacggtgcgtagtcatattccatggtgttggtatctaggaaagtggcttcgtttcgccgtcccatttcaaccgcaaattgatccataattcctgaattaaccttaatatagttattttcgacacgttgccccgccttgacgagttcaatcggcgtaatccgcaagttaaactggtcgtttaaaatggtgcccatcagcatttcaatcgaggcagatgatgacaaccccgccccatccggtagatcaccttccaaatacaattcaaaaccgtgatcataatcgcgagagagttcgcgaatttctagcatcattccacgtaaatagttgctccacttatatttcgcatcgtattcaagatcgttaacgtcaaattcgataatgccagtatccgggaggttacctgaatacatcttcacctgcgtatcatcacgaccacggtacgcgccgtaagttcccaggctaatcgcacaaggaaagacgtgaccaccgttataatcggtatgctcaccgattaaattaattcgtcctggtgaaaaatagacttcttcagcttcagttttgaaaatttgatggaacttttctgcaattgcttctttaagcataattatcctccaaattggtttcattctgttacgggaaacggtttcacgtagtattctacaccaattttcagtaggattaaacgaaacgctaccagacgcggtttaacgcgcatcccaatcaatcggactttgtgcagctaagatttgatcaatttgcgtgagttcgtcatcagtaaagtcgcggtttttgagtgcattgacgttgttaattacctgctgtacccgacttgcgccaattaatacacttgctaccactggcttccgcaagttccacgctaacgccatttgtgccaaactttgtccccgctttttcgcaacttcgtttaatttttttacggtttcaagggtctcttccacttgtacaggactcaagaacggaatggtttgcttctttgcgcgtgaattttcgtcaattccttgtaaatatttatccgttagcaatccttgcgacaatgaactgtaactagttgccgccttcccttcgcgttccaaaacggggaagaggtccgtttctacgtcccggttaaacatgttgtaacggggttggttaataataaatggtgttcgtaactctttgaaaatcttagtgattgccgccgtttgttctccgttatagttggaaattcccacataaagagctttcccagaacgaaccagctggtctaatgctaatgctgtttcttcaacaggagtcttcggatccgcacggtggctgtagaatatatcaaaataatctaaaccagtccgttttaagctttggtccgcactcgcgataatgctcttccgggatccccaatttccataaggtccgggccacattacaaaccccgccttactggcaattaccatttcgtcacgatagtggtgtaaatcacttttcataatccgtccaaaattttcttcggcactccctggaatgggtccgtaattattagctaaatcaaagtaggtgattcctaggtcaaaagctttaaatagaatttccttttgattttctaacggatccacgctaccaaagttattccaaaggcctaacccaatcgcggataacttcaatccactgttacccacccgattataaatcatattgtcataacgctgttcactagctttatacattattactcctcctttttgatcactcgtcacagcaacaatacagcttataaaaataaaatacaagtaaccgcttcacttcttatagaaaaaacacttactcttagccctggagctaactggcgaaaaacaccagctaatatagcttaacatcaagcatcaaaatctgtcaacaactttttttgaattaagatttttttaaatcgctcaatgccttggtgcgcccttatcgaagagcacttaaatatagtatcaagattactaaatcaggtcaaggctttttttaaaaaaaataaaaaaacgagcttattcgctcgtttttttaggtgctatccgattaatccgatttggttttattaccgttgcaaacattcccgcaaacattccaaaatagtaagtgagcaaacgccaaattatcatggctaaaaccagcttgctactattacctacaaattgggcaaagataacactaaatccatactccgcccctcctgcacctccaggaatgggaaatagtgaaattaccatgaagatcagcacgtgcaagcacgtcaccataatcagatgcacgtgagtctttcctaacgctaataggatgaaatatggaattagataataaaacagtagttgcaaaaaggttaataacgctaccttggctaataaccgccattgcgacttcatccgtacgctttctaagtagaaagtatctacctttgcatcaatcgacgtcttccaccttaaataacgctctggtttagtgaatcgtttaatcggaataaagataaggtcaaacattttcttggtaaagttatgccagtacataatcatcaataacccgataattactgctaaatgaatcaaaaaaccaaatagcacaaaccaagaaagaaatttaatcttatcttccaaatactggaagccaatcaacaggctaaaaataaagttcaatacaaccattgattgaaaaaccacgaacttcattaatagtactgaactagctcggccgccttcaataccactctgcattaaagccactaactgagctggctgtcccccggaagaaaacggcgtcagtccattaaagagctgctcaatcaatggaattcgaattgcatctttccaagacagtcggtcaccattactttctaccaatactttagttgcaacggcttcgaagcctagatacaagataatacataatagggccactaaaagccagcccacgtttagattcaaaatatcatgcgagacttggtgcaaattaaccccacgcaacgaatagccaaaaattacaaatccggccaaaatcatcacgacaaggacaatcttgtttttccttgtaataatgattcccccctatttaagcaaagatgaataatattttagccaaatctctgctaaatgatcttctgaatattctgccgaagcttggtctgcacgctgctgataatccctcagttgtgccggatttttgactaacgcactcaatttttgatccatttcagcgtaattgtccgccgcaatgtaatagcccttaataattgaatgatacaagtctaaatcacgtaacatcaccggggttccgcaactgaaggcctcgagaaccgacatcggaaacagttcattataagaaggcaataaaaataagtccgcggcattatagtattccactaacttattccgatccacaattccagtaaattttaagtttgctggaggattatcaaccaccttttttaaatcagcatacccatccgttaacctaccaaacgaaaatccgcctgcccagataaagtacatctctgggtgttgttgagcaagcttgataaaatcctttacgccttttcgttcttgcacttgaccaattcctaggatggtaaaacggttttgcacacctagtcgttccctaacttggcggcgctgttcggcatcatactggtaaaactcgtccttccgaacaaaattaggtatgtaagtaataatttcccgtttaattccgtacttaactaactgatcaataaaagttgggttcactactacaatctgatccattcgtttatagaacgcgataatgtatttatagaataaccaacgaaagggttgtggaatcttaagactcccctcgatagtttctgggagaaaatggacgtatcccacctttacgccccgctttttagtaaaagtggacgcgaaaaattggggatcaatcgtatggtaatgactgatatccgcttgcgtataacgattaattgataaatcaatttctttaggaaaatgcgtcttcagcaaacgaatcaattcttcatacgcactaccaactccctgtcccttaaccttactggcggacgaaaacatgttcaccttaattggcataacctaactaacccctaacgttaaacaaaattattccagttcagactctttctttgagccatgttctaaatcggcatgagcgctgattgcactattatagtaatctacaatccgcttcccaaaataatccgcggaaatttcatagagcttcttttcccgaggacgtggatcatcaaattcatccggatgttcaatataccgcttaattgcttgcacgagctgcgcttcggtatcaaaaaccttccctaacgaaggatcatctagcaactcatccgtatacggccctgatttggccaccacttttaaatgcgaagccattgcttcaatatacgttaacccctgcgattccgaatcagaagccgaaacaaataggtcggccgcttgataataacggtaaacttgatcattattaatttcgcccgtaaatttaacgtgcttttccaagcctaaatcatgaacctggttttccaagctagtccgcgcaggaccatcccccactatcaacaactgggcatccggaacttcctttaagattgcggggaagcaatcaatcacttcttggatattcttttcgtacgccaagcgacttaaggatagcaaaactggtgtctttgcatcataccctaatgcttcacgacattgttggggattgctatctttttggtactgctccaaattaacccccgttggaatgatgcgcgtgggaacttgaatcccgtaacgttgaattgttcgctgcacccgttcgcttggagcaacaattccgtcaatgtgataacaaaacgcccgcgtcatctgcttaacgtggtacggcttgagtaatttcccgttggccacatagtgtaaataatcctcatacatcgtgtggtacgtatggattactgggattttcaaagctttagcaacaaactttcccatccaacctaaggaaaactccgtctgggtgtggacaatatcaaggttaagttccttagcaatctgagtagcacgaataaacccactgattgcaattcgacggtcggtaaatgacacaaacggaatgctagtaaaacgaaatacgttccgttcatagacgtttgtatcaactttcggatccgtcgtcgtgaaaatataaacttgatgtccctgtttttctaactgatcacgcaacgttttaattgacgttgctaccccactaacttgtggaaaataggtgtcagtaaacagtccaatattcacagcgaatctccctctttgtcctaattaaactactttctctaattatattggtttaaaatgcgatatgcaaacagctgcctcgaccttataaaaaacgtaaaactagttggttgaattgggcgggctcttctgccatcggaatgtggccaacgtttggcattacctccacttgaatacgggaattgagctgtttaagtgcatcccccatctggggattaaagaacggactcttttcccctaagataaacaatactggttttgtggctgctcgcaaaaccggacgccaatcctttctcgcgtgtcccttcactaaagaacggtttttaggctgtgaaaaaggatatttagaatcaatggccttagaattcttataaacgtacccctcaattcggcggtaagctggcagtaaaataggctcgctcatcagttgttcaaagttagcttcgcttaaatttttaaaaccgtaatgccattgatcatcgttcatcattctaggcgattgatcaacgaagatagccttgctaacaaaattccagctccggatcgataaaatattccataaaacagtggcccccatcgaattgccaattccaattggttctttaatctctaaggcatccactaattgaagtacttcgtcagccaaatcgccaatcttcaaatcatagtcaacccggtccgaacgaccatggttaaggtagtccaaccgaatcacccggtaaccatgttgtaagaagaaattaacttgtcccgaccaaatttccgtgtttccaccaaagcccgttaaaaacaggatggggatcccttctccttggtcttcgtaatagatggtttctccagtttttagtataaattccatacgtcgctccttatataaaacaaaaaggaaccgcgacccaatggtcaacggttcccagttaacttattcagcttacttgttattaacagtttcttcaactaacttaattacatcttcgttagtttccgcttctgtgatagccttttcagctaacttcttcatatcgtccgtgcttagcttcttcatcaatgaacgagtcttcaaaattgaagtagcgctcattgagaattcatccaaaccaagacccattagaattggtacagcgatttgatcgccagccatttcaccacacatcccggtccacttgccttccgcatgggaagcatcgatcgtttgcttaatcaaacgaagaagggatgggttgtatggttgataaagatatgaaaccttttcgttaccacggtctgcagcaaatgagtattgaatcaaatcatttgtaccgatactgaagaaatcaacatacttagcgagcttatcagcgatcattgcagctgctgggatttccatcatcattccgacttggatttcaccaaccttagtacctgcatcgatcattttttgacgctcgtcgtcgtaaattgcccgagccttcttgaattcagctaccgtagcaatcattgggaacataattgctagcttaccgtatgctgaagcacgaagaagagcccgtaattgggtccggaacaaatccgtgcggtctaaactaatccggattgcccggtagcctaagaacggattcatttcttcaggtaatggtaagtaaggaaggtccttatctccaccaatatccatagtccgaactacaacttgattaccattcattccttcaacaacttttttgtaagcttcaaattgttgatcttcagaaggtaattcagaagcattcatgtacaagaattcagaacggaataaaccaactgcttcaccgccgttatccagaacaccttgtaagtcatctggagtaccaacgttagcagctaagtcaaagtgaacgccgtctttagaaacggtccgttcattctttaacttttcccattcagctttttgagctttgaaatctgcactcttttgttcgtattctttgatttcatcatcggaaggattgattagcgcatccccagttaaaccatcgacaatcatcatatcgccttgcttaacgctagtagtagccttttcagaacccactaccgcaggaatttccaaggtccgcgacataatggccgaatgtgaagtccgtccaccaatatcagtgatgaaacctttaacgtaacgacgatccaattgggccgtgtcactaggtgttaaatcgtgagcaacaatgatgacttcggagtcgatcaaagctggatttggcaattcaacaccaagtaagtgactcatcaaccgtttagtaacgtcacgaatatctgcagcccgttcttgcatgtaagcattgtcggtcattgcttcaaacatcgcgatgaaattgtcagtcacttcttttgtagcttcttcagcgttgatggtatcatttttgatcttatcttcaatgttaccaatcaactctggatctgaaagaatcgttagatgagcttcaaaaacttctgcttcttcagctccaagattttcagcagctttagctttaataagggttagttcctttttagactgttctaaagcatcatggagacgattaatttcagcatcgacatccgtaatagtcttcttttcgaaagaaagatcgggatccaccattaagtaagctttagcaatggcaattccatcactagctgctataccctttaatgtcccagtcattattcggaaagtccttctttcttcattgtgtcttcaagtgcagcgattgcgtcagcttcgtcgtcaccgtcagcagagattgtaacgtctgcgccttggccaacaccaagtgacattacacccatgattgacttcaagttaacagacttgtccttgtatgttaattgaatgtctgagttgaacttgcttgctgcttgtaccaacaatgttgctggacgagcatgaatacctgtttctgcaattacatgaaagtcgcgtttttccataatatatttctctccttagtaacactaaattttgctataaatgaagttgcttgtcgcgtcaaccatttacaagcctttgacaagataatatcaatttacgagccttaaagcaagcccttacataaaacaaaaatcaactaccttatttttttttgttattctcgtagcggtaagtaattgttccgccacgctgggcttcaccgatcagctgcttgcgttccggaaaatccataaaaaccggttggaagtcttgaaactcttcagcagtgatcgttaactcatcgagtaccccatcttttaaatcatttaaaagcttcaaataatcacgcattttaacacctcatttagcttatttattctatacctttatactaatttttacaatactggcgcctccacaataactttttccaattttgaatcaaactccttgcacaatttaaaagagcgtgtataatttagttatggtcaatattggtcaaacattttttgatgtaatggctgattagtttctttcataacttcattatagaagggagacagcacatgctttgtcaaaattgtcataagaacgaagcaaccattcatctatatactaacgtgaatggtcgaaggacagaggttaacctttgtcaaaattgctatcaacttttgaagaaccaacaacttaataacaataatggaaatggaggtgcgcgtatggcacaagatccatttggatttggtaacttagacgacattttccgtgcaatgcaaggtggcaacgtaagtcgtccggaagatatgtacggacaacaagttccccctactcaagcaggccgcggcggtggaaacaaccctaacggcggtaacggaagctctcttctaggccaatacggtttaaacttaacagatttagcaaaacaaggaaagatcgaccccgtgatcggtcgtgataaagaaattgaacgcgttattgaaattttgaatcgacggaccaagaacaacccggttttaattggtgaagccggagttggtaaaactgcggtagttgaaggtctggcacaacggattgtggaaggctcagtaccacaaaaattattgaataagcaaattattcgtttggacgtcgtttcattagttcaaggtaccggaattcgtggtcaattcgaacaacggatgcaggaattaatgaaggaagttcaaaataatccggacttaatcgtcttcattgatgaaattcacgaaattgtgggtgccggaaatgcggaaggcggcatggacgccggaaacgttttgaagcctgcccttgcacggggtgacttccaactagtcggggccaccactttgaaagagttccgggacattgaaaaggatgcggcgcttgctcgccggttgcaacccgttcaagtcgacgaacctagtgacgaagaagcaatcaagattttgaaaggtatccaaaagaagtacgaagattaccaccacgttcactacactgacgacgcgatcgtggcggcggttaagttgtctaaacggtatattcaagaccggtacttgccagataaggcaatcgaccttcttgatgaggccggctcaaagaagaacttaaccatcaacgtagcggatccggaaaccattcaaaagaagattgacgaagccgaagctgaaaagaagaaggctctggaatcggaagactacgaaaaagcagcctactaccgtgaccaagtttctaagttagaaaagaacaaggatggcgcaactaataaggaagatgaaccaaccattaccgcagaggatatggaaaagatcatcgaatcaaagacggacattccggtcggcgacttgcaaaaacaagagcaagaacagttgcaaaaccttgctagcaacttaaaagcgcatgttattggtcaagacgaagcagttgataagatttctcgagcaattcggcgaaaccggatcggacttaacggaaccggacggccaatcggttcgttcctcttcgttggtcctaccggagttggtaagactgaattggctaaacaattagctgatcaactctttggttccaaagatgccatgattcgttttgacatgagtgaatatatggagccacattcaatatctaaattgatcggttcgcctccagggtacgtgggctacgaagaagctggccaattaaccgaacaagttcggcggcacccttacagcttgattttgcttgatgaagtagaaaaagctcatccagacgtgatgcacatgttcttacaaattcttgacgacggtcgtttgactgattcacaaggtcggacggtcagcttcaaggatacgatcatcatcatgacttctaatgctggatcaggcgacgttgaagccgacgttggtttcggtgcggcaatgcaaggtaagacccattccgtactcgacaaacttggcaactacttcaagcctgaattccttaaccggtttgacgacatcgttgaattccacgcgttgactaaggataacctaatgcaaatcgtggacttgatgattgccgacgttaacaagatgctagcaacccaaggcttgcacgtgaacgttaccaaaccagtggaagaacgccttgtcgaacttggatacgatcctaagatgggtgctcggccattgcggcgggtcatccaagagcaaattgaagatcggatcgcggacttctacctcgatcacccaagtgaaaaacaattaattgctcgcatcaaggacgacaagattgaagttgcccctgacgacaaaaaataatttctgattagtttcttttaaaaatgggaccaggatttcattgctgaaattctggccccatttttttgttctgtttgttgggcttttgagtcgctgcgtagccgaaacgtgctttctgccccaacttcttccggttaactaaaatagggcatcaatcgccaaaaaacgcgattaatgccctattttttttaatcctcagaagctacccggggcaggaagcactcttataatatatccccattaaaaatcgaatttttcacaattacgtagtcgacctttctaatcgattccaaatcgcgtcctcccgcatatgaaatcgccgactgcaaatcttctcgcattgccttcaacgtatccgctaaatgtccgcgttgatgaatccaaatcttctttccttcgacgtttttcgcctctcccttttggtattgagaagcactaccgaagtattccttataagtgacgccatcttccaccttggtttcccctggtgattcgatatgtcctgcaaatagcgaaccaatcatcaccatggttgccccaaagcgaattgattttgcaatgtccccgtggttccggattccgccatcggcaatcagtggcttacgagcaacttttgcacaccaacgtaaagctgatagttgccagccgccggtcccaaaaccagtcttcaacttagtaatgcagacctttcctggtccaattccaattttagttgcgtccgcgccggcactttctagttcacgaaccccttcaggagtcccgacgtttccagcaattacaaaactttctggtaatttttctttaatgtaatgaatcatgtcaattacggtttgcgcatgcccgtgggccacgtcaatcgtaatgtagtcagggactaaattcttagcagctaattcgtcaataaagtcgtattcgccgtctttaacacccacactaatagaagaaatcaatcctttagccttcatttttttgacaaaagctaaccgagtttctggttcaaaacggtgcatgatgtaaaaatagccatctgccgctaacttttccgcaatttcttcgttgataatggtctgcatattagccggcactaccggtagcttaaacgtatgttttcccaattcaactgttggatcacattcactacggctgcgaacaacacatttagctggaattagttgaatgtcttcataatcaaatactttcattctggtcccctcgaattgattaaattaatggccaatcgccaccaagcaataatatacactaactttatcaacaaaacaagtttaaaaagttcgttttctcacctaataaatcgttaatatatttcttatcatctaatgataatgtcattatgcgaattattcaccatttctcccgcgattctagtgtaattgatccgcaaacaaaaaaagcacccaacttttaaatcgttggatgcttcttgaaaggcatttggttggcactttctttcgaaatccctttgtccgcaatgcttcaagccatataacaatgtccccggcgagaatcgaactcgcaacctatcgcttaggaggcgattgctctatccagttgagccacggagacctaacaatttagtattgcatgaattttaaattctgtaaagttgtcctgtcagattagtagcgccattcctaaaaggcatcccttattcagtccctagacaactaaaaaaaccgtccccagtaattattagatttttgtctaacaaatatggacggttcgtgatttctgaaacctcgttcagaacaatgctcgaatttgaaaatttttcaagctggtgtaacctagtatttcaaaaaattatctaggaagctttgccttttcaatgtttttcttatccaagtcttcgtacttaatccccgttacactttccatgccttcgcgtgtaacgattaattgcttaccaaatttccgaattgtgcccgttgggaagcgttctggatacttgttgtagattgttcgtacgtaatccttttgcttgccccacattaggcttgcttcacgacttccgattaattcatctgtgttaaggtcaatttttaaattttttgacatactcattcctcttttctctgcattcaaattcgcaaaatatcttgttatctaaatggtaaatcttgtttacacttatattagcaaaaaaactgtcgtatggcttgtaataggctcaaacttaatcttttttaaaatactagctactcccccctatgtatcacaagataataaacaaaaacgggcatactgtattttaccacaaagaaaaagatcaagaacaataaatataataaaaaactccaaaccggctctttttacccgatttggagttcctagaggaggcttaagcttttttagttgcttcactcatccgtactacaacccgaccatgtaaatcgtgcaattcctctgaacgtaaattagcaacgctggatgggtcaatttcgattaaaattgagttttcatagacttttccaacggttcctgcaaaaccagttggtagaagatcagttttcttcaccgtaacttcgtcgcctacatcaaatggtttcttttcgtcaactttttccttatccgccattattatctcctttaattccctgcattaatgttttcactctctacctgactattacttacgttagcagctccattagctgataacgccgcagttccggtttcggcgtgcttcaagccgaggccttttcttatgaaatcagtcacccgttgtaactcggtgtgggaaacaatttccatcgattgtccattgaccatttgaccactgccttgagcatgggtttcttcaatgttcttcgatgcggcccggtaattctttgccaagtccactaggttaccaaacgtaaagtcggtctgggtttcgttagcaatcgaatcgataaaatctttgttaagcaatgctgaaattgaactgctcttgccaaggatagcagttaacactgccctttgtctagtctgacgcccgtaatcgttttgcggatcgtcgtaacgcatccgggagtaagccagcgccttcttcccgtccatgtgagtcttgacaccctttttaaaggtataaccatcatacgtaaagctgagcgttggagtaatatcaactccaccaacttcgtcaacgaccttttgcatgccgcccatgttaactaagacgtagtaatcaatcggaatgttgaaaaccgattgtaccgcgcgaatcgcagttcctgccttaccaaacgcgtaagcagcgttaattttagacggcgacttttcttcgtatcctggaatggtaacccctaaatcccgcgggatgctagtaatcgtcgttttatttgtctttggattaatcgtaaccaccatcatactatcggtccgtcccttatacgaacgaccgagtgctccggtatccgttcccattaataggatcgaaattggctttttattagcaactaaatcggcggtattccgttgttttttaatacctgcactactgtaggtactatcaaccgcatttttgacgttctggtacttgcgcaccccatagaatattccaccaagcaaaataactgctataacaattaaaatagtattgcgcaccgtgtgcgacgctcttctacgttctctacgcataaaattatacccacctttcaacagtgactatattacactatttcaggccctttttaactaaaaaattgataattaagcaaaactaaataatatttaatttgatttctttacgcggggcttccccttccgtttcaaatgcttcttcttcccttttttcttaggctttgaggaagcaacggagctcaccttcgttgctgctttacgagttttaacatcccgcaaaggatctttttgtggcgcttcttcggtaactggcgcagacacttgtttttcgtccgccgcttgttcggcaacttgccgagctttagtagcggtcattatctggcggttagcaattgccaatttttctgctggttggtccagctctcgcaagatcttctttaagtttcggatgtcgtggtcatctcccaggctaatcacaaagcccgcctggcccatgcgtccggtccgtccaacccgatgagtgtaggtagtggcgtcccgcggaatgtcgtagttaattacggccgggaggttttcaatgtccaatccccgagccgcaacgtcggtaaccatcaataaggaaagttccttcttcttaaaccggcgcattgcggcagcccggtcaatttgtacctggtgtcccgcaattttgccgaccttaacgccttcgtgcttcaaaagggcggtaattttttccatcgtcgctacgtggttaaagaataccaacccttggaacttctttacccgacttaattggcgtaaaatttgtggtttgttcttcggtgaagcagttagccaaccgtgttgcaccgccccccgggtctggtcttcagcccggacgtcaattacttgcggcgttacgccaaaccaggtttgcaaatcatctattgcaaggtcgttagtggctgaaaagaagctcaattgaacgtcactcggtaattgatcttcaatctgacgaacgtcttcgagagcttcccccgtcaaaatttcgtcagcttcgtcaattactaaactctgaatttccttcaccttgaggcgtcgctcattaattaaggtaagcactcgtccaggggttcccacgataatctcgggtttcttcttttttaaccgttcaatctgtcgttgcacgttcgctccgccggtgattgaggtagtcttcaagttaattaaacttgcccactcgcgaaaaacgtccgtggtttggatcgccaattcttgggaaggcgccaatactaacaattgcggaccgttgcctggaatcactttttccagtaatggcaaagcaaacgctaaggttttcccagaaccggttggggaaagtcctaagacagtttcccccgcccggagcggttcggcaacccgttcttgaattaaggttggttgcttaaagcccttttcttgaaaatgttgttgaaataaatcgttcatgaaagtttaatcctcttctttttcattggtaaagtatatcttaccattttgccggaggttatagagcaatttattgacgtttcgactcaaagttagccattcttggtaatccttttggttctgcggatcatccggatcgttaattacccgcgcaaagtcagttgcttcggcaatcatcggattttcgtctggagtggtgctgatcaattccttgtctccggacgcattcaaatattcaacccggtttaattcagccgcgttgtccataataatggtgtctttcaaaccgtaaatttctgagccaatttctgaattgacgttctttccaacgtttaaaaccacgtcgtattctgggtaacgtaaaattgcgacgcccttaccatcggcgccagtgcgcaatttttggttgaagtaagccacttcgtctggcattccaaaccaaaccatcgcgtcgtatgcaaggtaaactccgaggtcttgcagcgcgcctccggcaaatttcaacgagaagatgtttggttcgttgccggatagataactatcaaaccgactagaatacttcgcataagttagcgttgcaccctgaatttcgtccatttcggcaatcttttgggtgattgctttgaaattaggttcgtgaatatgccgagctgcttcgaatagtttagcttgcgggtgcgcctttaaaattttgtctaatgccatccattcggtaggattggcaacgatgggcttttccactaccgctaccttaccggcttccaaaacttgtttagcttgagcgaagtgcaagctgttaggtgaggcaatgtaaacagcatcaacttcgtcatcgttaaccaaatcggcaatttggtcgtagaacttagttgccccgttcttatccccaaactcgtgtgccttttcgagagtccgtgaataaaccgctgtcaatttccattctttgctagcatgggcagcatccacatactgctgggtaatccaattagttccaataattccaaatttaatcatgctgttttcctcctttaaatttctaactctattctaccttaattaaggtaagttattcagcgtagaattgcaaaaatgttttctcgactggtaaattcgtaaagaattttttgttgccgcagatatttaaccacggaaaaatcaccgcccttgataagcgctttcattaatcgttgcagggtacaatattacaaaacgatttcgattacttcaattttttaacaagtgctaaaaactaagccgttttactacttcgcctacccaaataatgttatatttaagtggacaataaagagaaggagtatgggcgtatgaactggcaaaaaacagcacttggtgaccttttttcattaattcgtttcgattctaaaaaaaccgataaaactgaagaaaccgtcagtccgtttttctttgccgggacctggttatatcacgagcccaatactaatcgagaacacgaattaaaaattttacctaactacgacgtttacctggatggaaaattattgaaaacggtggtcgaagatttggatagttaccgaatcaccttcattgaccgttttggctaccacctcgtggttaaagccaacgaataccgcccaatcagcgtttacgatgaggctaacaacgaaacttacgcaattgttgatgcagaaaaagaacctgaaaatcgtcccgaaaaagaggattgattttcaggctcttttttcatttactgaaagttgcccatcatctagtacttctgccattcctgacgtccgccgttaaagtatgaaactggcaattcaatttcccggcggtcggtcttcagcgtccactgatcatcgtattccacaaattctacgtgccggtcggccttttgaactttctcggcttccaaccaaaaccggctttgtttaacgtattttggatacagtcgttgccgaatttttggagtagtcttgattacgaccggttgtccataataattagctaaccgccggaccaaatcggctaagatggggccctgcttcttccaatccaccttctccgccgtatcttccccgtagtagctcacccggattaccaccgggagctgcccggtattacttttcactttgcgactaatatattgaagctgctttaccgcacttctttcaaaactaaagttatgcaccaccccgaccttaaggttagttgcacgtaaccggtcgtagttcgtgttaaacgaatcatcaaagtacgtggcgcccgtcgtcgcatttaaatagacaaattttactttttgcttagccaaatcttgaaaattgacgatcccatctgcttgatcaatcacgcatccgcggattgaatatggtgaaagggtctgctgttcttgctgttggacgtgccaaaagattccccagcctcccgcaattagtaacgccaacgcgactacgatggaaagaatcaatcggcgttgacgtttaatggctgccttagcaaaccggggacgctgagccgcgcgcagattttgtttcatcgtgccgcctcctcattgttgaatattgtacacttatcccctataatattcgaattatcattaaaaatattttcagaaaacacgaacgtttctggcaacgttcgttcagggggtttttatgaataattcaaaaccaaagcagctgcaaaaaaacatcggtttatttgcagctttttcaaccgtaatgggcacggtaatcggcgcgggggtcttctttaaagtagccagcgtcaccgccagtacccaatccgcggggcttagtttactagcttggcttgcgggaggaatcttgaccatttgtggcgggttaaccagtgccgaacttgccgcagccatcccggtgaccggaggcgcgattaagtatcttgaagccagttacggcaaactgaccggctttttaatgggctgggcacaaaccttgatttattttccggctaacatcgccgccctttcaatcatctttagtacccaattaatcaatttattgcacttatccaatgggcttttggtgcccatcgccatgctttgtggcgcgtcggtcaccggagtcaacctactgggtgctaagtacggggcgcgattacaatcggtcgccctcattgctaagttaatcccgctgatcgtgatcgtaatttggggactgggttccagtagtccggtgcacctcagcctgctaccagcaaacagtcacttttcccaaaccttaaccggatttagcggcggcttgctagccaccctatttgcttacgatggttggttaggaattggagcaattgccggcgaaatgaaaaatcccaaacgtgacttacctttagcaattggcttggggctcactggaattatggtggtctacttagtgattaatttcatcttcttgcggaccctgccaatccacgaacttgccggcaaccttaacgccgcctccgtggcagccacccacctgctaggtaacttgggcggtaaactagttaccattggaattttgatttccgtatacggcgcactgaatggatacacaatgactggaattcgggtgccttacgcaatggctttagaaaattcgttgccattcagtcgggctttaaaacggctttcccgcaccagcgtgccgtacgtagccggattactacaattagtaatcgcccttttgatgattagcgtcggttcctttgacttattaaccgacatgttaattttcgtaatgtggatttttaacgttttaatcttttacgcggtgattaaattgcgccgcacccaacctgaattagaacggccataccgggtgccgctttatccgttattgccaattgtggcgatcctcggcgggactttcgtattggtcatgaccatcatcaaccaaccggttctagcaattaccggaattattataactttgttaggaatccccgtatttcttgcgaccaatcgcgctaatcgttaagataaatgcataactaaattaggaggctaactaatgtttattatcaagtacatcccctttcttggcctcgcgttaatcattttgatcggctgtttgattgcttacgagcggcgcccttcgttagaccgggccgtagttttcggtagtttagccgtgtacttagtttgtgtagcgtggctcttatttaccccgggacaatacttctttgacccgtacgcgtattacgcccgctatttctattggcatcacgctaaaattatctactacccttcggcattgcgctcgatgggttcgtacatgaacatcgtaatgacgattccagccggcgtttatctcggaattttattccaccggcacctaaactggctgactgtcattctttgcgcaggcctagtcggaattttcaacgaaggtaaccaactaattttggacatgatcattaacatccaacgtactgtggacattaccgacgttctcactaacgcggccggagtggtaatcggctaccttgccttttactgcttggttcgtccgtggttgaagaatactagctttgcctaattgctcgataccaaaaagagcgtggaacaaaaggttggtagtttacaagcattaaataaaaaaacgagtgttatgcctaaatttggcataacgctcgttttttggttaagcgaaataaaataacttttggcgcacgtttcgactttattaaagtcaaaacgccaaaataatatttagtttttttcagcttcttttattatgccgtcgccgacttcggcgcaatcttcgcccgattcaagagtaccgaactcgtgactacggatagtgaactaaacgccattgctaagcctgctaattccggactaaggataattccagcgaggtagaaaacaccggccgccaccggaatgcccaaaacattgtaaatgaacgcccaaaagaggtttaacttaatccggttaaaggtcttgcggctcaattccaatgcttttgcaacgtcgcgcaaatcgtttttcactagcacaatgccaccggattcgattgcaatgtcggttccagaacccattgcgattcctacatctgcggtactcaatgcgggagcgtcattgataccatccccaacgaaggcaaccttaccggccttttggaaattctttacccgttcggccttatcccgtggaaggacttcggcaattaccgtgtcgattccgacctgtcgcgcaatcgccttggcgaccacgtggttatccccggttagcatgaccggttgtaacccttgggcctttaattcggcaatggccgccttagaagtgggcttgggtgcgtcttggatggcaattaaaccgatcacccggttgtctagtaccaccacgaccaccgttttcgccgccttttgtaaatccatcatcgcattttgccactgctcgtcgatggcaaggtcatccaataacttttcgttccctactaaggcagttttgccgtttagctgcgcttttacacccttgccttccacggccgtaaagttagtgaccgtcgccggggcgatgtccgctttttgcgccgccttagtgattgcagttgctaagggatgttcggaagattgttcgaggctagctgccacccgtaaaacctggtctcggtcgccaaccacgtcggtcacttccggagtaccgttagtaatcgtgccggtcttatcaaagataatggttttaacttcgttaaccttttccaaaacttcaccattcttgattaaaattcccatcttagctccccggccagtaccgaccattaacgccgtaggggttgccaaaccaagggcacatggacacgcaatcaccacgaccgaaaccgcaaagatcaacgcatgcgctagcgtagccccgaggaagacgtaccatactaagaaagtcgcgattgccaaaatcaagaccaccggcacgaaaatatcggaaacccggtcggtcaaattctggattggagcatggctgttttgggccttcttcaccaattcaacaatttgcgccaacatggtgtcattgccgactttgctagctttaaagacgaaggtcccggtgttattaattgtcgagccaatcacgtggtcgccagcctttttagttaccggcatgctttcccccgtcaccattgattcgtcaatcgtcgaggaacccgattcaatcactccgtcaacggcaattttttcgcctggccgtacccgaatctggtcgcccacggccacttcgctaagcggcaccttgacgtactttccgtcgcgaagcacttcggcttccttagcttgcaaattaaccagcttttcgaccgcttccgaagcattgttccgcattttttcttcaaaaacctggcccaataagacgaaagtggtaacgaatgccgcactttcaaagaagaccgcttggccggtaatcatcgcgtaaatactgtagaagtacgccgtcgcggtcccgattgccaccagcgtatccatgttggaatggtgttttttaaacgaagcccacgcactttgcgcaaatgggcgcgcggacaacgccattaccacggtagttaaggctaacatcgtccagtggccaccgggaagcatgaacccccacggtttcaagatcatttcgaccaacattggcaacgaaaaaattaacgaaatccaaaaacgagttgtaattttcattactcaatcaccacttttccgctaaacatgtccattccacaactaaacgagaattctcccgcgtggtccgtattgatggtgaccgacttggtttcgtcaagcggtaactgttcttcaaatccaagttgcgaagaatgcaccacgtccaaacagccttgtggactggtccgccgaaagttaatttgtgcagggacccccttttgaaaatgcacttcggccggttgataaccgccagcgaccgtaacgttaacgacttgcgtttgctctttcatttaaatgacctcccttagctatttaacttcgactttgccatggaacatatccattccgcatgcccacggatattcgccagccttgctggtatcgattttgattggcacggtttggttttgtggtaaggcttggttaatcccaaagtccgcgaaaaccacccggtccaaacagcttgacggatccttccgggtaaagtttagaactgccggaacgccctttttcaaaacaatcttttcgggagagtaacctccgttaacctccacatcgaccgtctgggtatcgccagtaacttccgccacttccgattgggcttcgtgtttaccgaagaaccaccaaacgataaaaccaattagcgctaatcctactattaaaacaatcaatctcgtcatcatctaatccccctctttcatggtgcaagtttcgtcacaatccgtttctggaagacaattgcattccacctttgctggcgcggtggttgctttttgttgcaataactcctgtaaattgctaatatcctgcttacttaaggtagtctgggcaactaaattggtgattacctgccccttcttcatgttgcacatgtggtcaaagagctcggtagtcgtcgcctccatcgcctgtttttcggcaatggtgggatggtaaataaacttccgacccagccgttcggtacgcaacgcgcccttggccactaaccggcgtaatagcgttttgatggtggaagccgtccacttttttgattgctgcatcaagtggacaatttccgtgcttttcgcctcaccgagcgtccaaacgatccgcataatttcccattcggcaccgctaagttccgttgcggtattttccattgtggcattcctcccttttacgtttacatttgtaaccttcatgattagtataaaaggcaggtttacatttgtcaacgtaaaagctcctttcttatcatgacccgctatagtattctattaaaggggaaaatttaacaactggaggagcttttatgccaaagtacctaaaatggggattaatcatcctcttttttccaatttcattgagttattatgcctaccggtggagtaaagaccgcctttgggcaaaaagtaattatccacgagtcttttcgggactaaccgtctgggcaatttggctgatgcttttagtgatcgcccaaagtacatcctttgccaatgccgtatcattactaggatttgctggattgatttcgtttgtaattgccctaattattgatttatttcataagaaatcagcccggcccgcaattgttcccgtaatcttgagtgcagttttatttgtgggggcagcgcagtttatcccggatacggagtctagttcatccgctgctcaagtagaaagcacccacgtggtccataaggtggcgcgcagtgaccaaaaagattaccaagccgctaaggcaaagcacgccgcactcgttgcccaactaaaaaaggttaagcacgagaacgcaaccttagctagcgagaaagcggaggccgccaccgcaattgccacttccaaagccaagcgcgaagaagcttcctcacgctcagccgcggcaagcgaagctgccgcatcccgcgccgagagtgaaagtaaagcagctgtggcttcatctaaaaaggtggcccaagcacaacaaaaagcggccgcagcgcaaagtcgggccgctgcccaacaaagtcgccaggccgctcggcaacaatccgcaatgcaagcaaatgatgacgaaggcgatacatacaccggaaccgcccaggacattattggcaacgttaattcccacatttaccacgtccctgggcaagctggttaccacatgaattcagctaacgcggttcacttccattccgaagcagaagcccaagctgcaggttatcgaaaggcgttgagataatgaaattaaaagcaaaattactattagtagtcgtgccatttttgatggggagcgtggtttaccaccctactccaacggttcaagccaagaccgtggtgaagtatacccacccgcaccgcaaagccacccgtaaacttcagaaggaaaaccgggagctgaagcaaaagattgcaaaagcacaggctaaaaatgaccggctcaccaaacaactaaaccacaagaagaaacaacttcatcaatcggcggctgccaaacaaaccgatactgctaacctagccaagctaaattatgctggccaacaagaagttgtcattaaccacaatcagccgaagttttccaaggctgatctagctaccgacaaaggggcttggcaacgttacggcaaccttgaccacctcaaccgggcgacggctgccaacgccatgctaaaccaatccttgatgcccactgccaaacgcgaaccgttaaccgtaaaccccaccggttggcacaataagcggattgcttcgggatggttatataatcgcagtcacttaattggctaccaattaaccggccaaaacaataacttaaaaaacctaatgaccggaacccgttcattgaattcgccagaaatgctcgcccatgaaatggacatcgcctactacctaaaacaggaccctaaacactacgttcgttaccgcgtcacccccattttcaacgacgacgacctgttagcccgcggcgtccaaatggaagcccagtccatcggcgacaacgacatccatttcaacgtcttcatcttcaacgtccaagatggcgtgaagttaaattacgcggatgggactagttcggtggagaaataagaaaaatccagattgcttaggaaacgttattcctgagaatctggattttttaaatattcaatttatcacaataagtgacagatcctattcaaacatagcagccatgctcattaaggtgtggcttcttttttatatttctaaaaattttttatcaaacaatacgttagagtatccattttaaaaattacgtctagcatgttccacgaatttaaatttatctgcccgatgaacagacttagtgaagtgtaacaacgtattatcctgtaaatgagtagtacttttcacaacaactacaggtattttagaacttatattcaaaatattctgttcttctttactagccgcctcgacagtaacttctttaatagcataaccaatttccaaatgtagatctttttcaaaatatttatatagtgacctttcagcaacctcgttactaatctctggtaccacagattttagtacataatcattatcaatcaccaatggttctccatcaactattcgtaatctttgtatgtaagttgcaggtataatttcatcacggtctaacttaaatgtatcctgaggaacattttggttctctagttttaagaccttagtttgggttttcatttcaaataattcatttagctcttcataacttatcattttagaaagaggaaatgcatatttatctgatgccaatacaattgatccttttccttgaatcttatgaatgaggccactttcatttagtaaagaaagcgctttccgaactgtctcacgagaggtatggtataaattcactaattcattctcacttggcaaatacgattctggtgggtagataccatgattaattttactaactagatcacgatatattagatcatatttttttatcatctatatccccttctttcactttctttatattattaattactaagttagattgcaacctacaaaataaactttaccaaataatcgttgacaacttgtatatacatgttgtatattttccttatcaattgaagcgctttcaaattgtggttgctatatattaaaactatttattaaattacaggaggcacaaatatggctcgaaaggattattcccaacttgctaaagatattgtagcgctggtcggaggcaaggaaaacattgaaaatttgattcactgtataacaagattaagattctatctgaaagacgaaagtctagctcagactgctaaaattaaggctcttaatggagttattgacgtacaaaaagcatcagatcaataccaatttgttattggaaatcaagttactgcagtttacgacgaaatcattaaattaattggttctgaattcgatgatgaagaaaaagcatcctcaacagctgcagctgataagcctaaaccacaagaaaacttatcactatgggaaaatgtaaaaaagaaatttagtgagctaattggcgtaattactgcagcaatgagccctatcattggtgctttagcagcaagtggtattttaaaaggaattttagcaatattaacgatgccccaacttggagaattagttagtcccacttcaactttctacacagttatcaatgctgttagtgattccgttttctactttttgccaatattagttggttatacagctgctaaaaggcttaagggtgacccaattctgactgcaatcgttggaggtgttttagtacatccgacattagtagctttaaatggtaagtcgcttcttaaaattggcggcttacagtttccaatggttaattacacttactctattttcccaatgattttagctgcatggttagtcgctaagttagcaaaatgggttaaaagttggttgcctggatatttacaaattatctttaccccgctaatagtaattgcagtaacttcagcaattactctgtacataactggtacaacaatcatttggctatctaaaggactcgccaacgtaatccaatggttattgttatcaagtggttggctatcaggattagtaatcggcggtttataccaagtactagtaattttcgggctacattggggaattttgccgttattagcaaatgatattgccacaactggacacagctacttaaatgctatcttaagcacaaccatggttgcacaaggtgccgccgtattggctgttgccattaaaactaaaaagaccgatttgaaagaaatttcatttggtggagctatttcagcattttgtggtgttactgagcccgcaatctacggtgtaaatcttaagtttaagcaagttttcatttctgggctattaggctcagctgccggtggctttgtaacgggacttttacatggtaatatgtttggatttgccggttcatggataggctttgcatcatttttagatccaaagaatccaagcgacctttctaatctatggattttcattctctcttcagcagttgcaacaatcgttccatttatagctacgtatacttggggatacaacgacaagatggttcctggagaaggaatggcaaaaccagtcagccctgcaaaaaaataaattcttaaagtgattaggagagaaatagtatggaatggtggaaaaaagcaacagtttatcaaatatatccgcgaagttttcaagactcaaatggagatggtattggcgatattaaaggaattattcaacgactaggatacttaaagaaactaggaattgatttaatctggcttacgcctatgtatgtatccccatgcagagataatggttacgatattgccgactactacaatatcgacccggtctttgggacaatagccgattttaaggaattaattaaaaaattacatcaattgaatatagggataatgatggatgtggtagttaaccatacttctgatcaacaccattggtttaaagaaagcattaagtctaaagacaatccttaccacgattactatatttggaaagacccggttaatggaaaagaacctaataattggttatctaaattcagtggttcagcttgggaatatgtaccggaactagatcaatattaccttcacttatatgagaaaactatgcccgatttaaattggcgaaatcctaagttacgtgaagaaatatttaaaatgatgcaatattggacaaatttaggaatcgacggtatgcgactcgacgttattaataatatttctaaagataagaacttccctaatgatacctttaaaacacctgctgatgacggtcgaaacttttatacaaatggtcctcacgtacatgagtatatccatgaaatgtatcaaaaagtttttggccctaataaattagttactgttggagaattatcctctacccccatttctgaagcgattaagtacactaatccaagtcgccaagaattatcaatggctttcaccttccaccatatgaaggttgattacactgatggaaaaaaatggactttaggcaagttttatttacctaaattaaaaaaagcgcttagtgattggcaaattggaatgcaggaaggtaacggttggaatgctcttttttggaccaaccatgatcaacctcgcgccatctcaaggtttctaaatgatactaagtatcgcagtgaatcagcaaagcttttagctttagtagaatttggtttaatgggtaccacctttatttatcaaggtgaagaaattgctatgaagaatgcttatttctcagatattaaccaatacaatgacagagaatctattaatgcatataatcatatgcttaaagatggaatatctagagacaaagccattcaaatcttacaacaaaagtctcgcgaaaattgccgaattcctatgcaatgggataacaccgtgaaccatggattcactactggtactccttggctaaagcctattttaaaagatgatttttctgttaaagatacactaaagcaaaaaaataacgtattcaatttttatcaaaaactgattcagctccgaaaaaaagaagacattctaataaacggaaaatatcgcgtgcttgaagaagatgacgaatctgtttttacgtatgaaaggtttaacggaaatcgtacaatcagaataattgcaaacttcacagaagaattccaggcaagagaagtgccggacaatattgacattattataggaaattatcctgaacaacgcgttgaaaatagcatgattaaattgcagccatacgaagctgtcatgatttcatattaaaagaggttacagtaagatgtttaaatttccttttaaaaaagcaaacaatcaaatcacagccccagtctcaggaatttatcttccaattgaaaaagtaagcgatcaggtatttgcaagcaaagctgtaggtgacggcttcgctattagtccaaatttgaatgaggaagttatttactcttcagttaccggaaaagttacatcaatttttccaactaagcatgcgatcaccttaaaaattaatgatggtacagaagtgttgctccattttggtatcgacactgtcgatttaaacggagcaccatttgaaatgctagtcagtgctaaccaaaaagtaaataatagtactcctttagttaaagtggactggcaacaattagtgaatgctcaaaaagagacatcggttatagtcgttagtgctaattcaacatttagctctaatatggatgagaaaaacaacaaagttagtaaagaaactgttatagggaagtttaccctagcaaaatgaaacagatacaacactattagtgccaaaatattggttacaattctttataaaacgccaaacttataattaactgcggtgtggataaacagccttaactgtctatccacacttttttacaaaaaaaacatactatcaattcttaaagtttcaatcatgccttccaaaacataaccaaaagtaaatgatagtatgttccataaaaatactacacatgataatttcactacattttgtttataacatctccttaattctccccaaaaagtcctcgtaactcgtgcttccgaccaattcagcaatattcttttcttccgtcatcacgtccgataacctatcaaaaatgtttctaaacaacttagaatcttcctttcgcacagctaaagcgaatactaggtaaacgcgattcgttccccaagttagcccgttaggattgatataaatgaaccccttggtactatgcgctttcatggttaacgaatggggaattgctattttgccaaacgccgtggacgacatttgttccctagccaacaaatctttttggtaatcctggtcggttaccttagcttggtaaaaggcattggcaatatgctcaataacggcttccttcgtttttaattgtcgactaatcgtgaaaaaacgttggtcgaaaaatgttccaatttggctatcaaatgccctccgccgcttttcattaccaatttcatcgatcttattttttagcatgcgattatcatttttcgtaaagaatggcgagatttgtacactgggtactctagttgagattctatctgtaaaggcaattaataaatcaagatcgttttctactgcagactctgtggtgacgacctttgtaattactagttcactaccaaaattcttctcaatttgatcgacaattgatagaaattttccctgataatctggaattaaaattgttgtccttagccgttctttatcttcaatctgttttgcaatggcatttccaatatgcatagcaatgtaggcaatctcgttatcaggaaccggcactcctacatagtttgcaatcttatgagaaattagtaccgcacattcgtaaacagtaggactttgagccttcatttgattagccatcgggttttgaatgcttttcccatctcgcaaccgttgaattaaccggctaacgtgaatcgcaaattgatttataaaatcaggtcccgtcaaatcaattttataaatgctcttcacataagcaagaatgacgcgaattaagcgtaatgaactttctgaaatactgtctttcatatcaatcgtccatcgggaaaccgaaccatcaatgaccagccccagactttctaagtcatctttagaaaaacgaacgtttgcctgactgttttcaacttcctttagtaaatctttggcaaagcgactacttttccagtaaaaaatcatctaactgtggttgcgtttgatatccatctctaatccgttggatggcaattaccacgtgtaaaacaatgttattcaaatcaaaagtattcaaataaatgtgatgttcctttgcacatacttgcgtaatcgtgtacagttcgtctaaatcaattgtaggaaagttactttgaataattgatttactaacaaaatttccgtcgctttctttatatagcatgtctgaaagcatgtgtcgcttatcttcttcgctaccagaaatagagaaataatcccctcgctgtttcaaaattaagccaaaatttttcgcgtattttacggccgctttaaaatcaagttttaaattagattcactagcaaaaatttcttcagctaggtcgtacacgtttaccggcgcatcgttgcttagcaatctattgagtacgtaaaaaatccgctcccgcttagtagttgggattttggaaccttttgattccggttgtttttcactaatttctctagtgccctcatatttatagcccaactttgaagaagccaccgggtgatctgctgataaatttttatagtactttttaacacttctacccgacacatccaaaaaaatcgatagttcttgaacactatgccaccccggtttggtcatgaggtaccggagcatttcctcttctctttttgtggacatcattatatcccctaatcatgagcattaactatgcttaatttgaaaacttgccaattaaaatgtggctttctacgcaaaatttcgcgaaaagcatttaaaatagcctaatcgcgaaattataattttttacctaaagttcttcgccattcgtagcgataactttcttgtaccaagtaaaactatcttttttgtaccgtgcgccagttccgttcccttcatcatctaagtctacgtaaatgaagccataacgcttagacatttgttgagaagaacaagaaacgatgtcaataggcccccatgcacaatacgcaattacgttagccccgtcatgaattgcacgaccaacttgttcaatatgttgtcttaaataatccacccggtaatcatcatgggcttttttgtcttcagttaattcgtcatacattccaattccattttccgcaatgataattggcttaccgtaccgatccgcatactgcgaaagcgtgttgtaaaatccttgagggtcaattgcccaaccccatggggaagccttcaaatatggattaggtgtagtatcgttaacttcatacttgttcttagtggaatcaaccatttgagagtagtagtatgaaatccctaagaaatccattgggttctctttgatcaacttcatttctgcatcagtaatcgccaacttgatgtcgtgatccgcaaaataattttgggcaaatttagggtaagctcccctaaactgcacgtcggtaaacatgtattgcattcgattgtgctgtaatgctaatacaacgtcagtcggtttcgccgtcgcaggaaagacggtaccgtcagctaccatggttccaatatttaaattaggatgattaagagttttggcgtagctcttaatccaagccgccaccaccatctgattatgagttgactggtataatgcttctgccaaattatcgtactggtccgctgccacccccgcggataaccatggttcggtttataccatattaatttggttaactacaatccagtacttaacccggtcgccaaaccaatctagtaaagtctttccaaatttttcaaacatcggaatcacatctttatttggccaaccgccatatttaaaagtgatgttaagcggagtttcgtaatggttcatcgtgatgattggctcaatatttttacttaaaagataatcaatcatctttgaataatgctctaatgccgcaacgttgggttcttcgtcatccccgttaggaaaaattcgtgaccaatctaaggaagttcgaaaggtcttaaaacccatttcactcagtaaatcaatatcactctcgtacgtatggtaaaaatcgataccgtagcgcttagggtaatagtgttcctggtcggtcactcctgctttggcttgtgctaatgtcatcccttgtacttctattttttgaatttcttcattagaaagtccttttaaaaaaggttggacatctgaggagtttagtcctttaccatcttcacgataagcaccatctgcttgactagctgcttgagctcctccccacaaaaaattctttggaaaatacgaatactgatttttcataataaaattcctttcttatctttttccttctttgcgttcaaatatgtcaattaacttcttagatagattgtattcactcatgatggtcattaccgtgtcttgagcatgggtaaacagcactgaatactctacggcatcgccttccgcttctttttgtagtttcttagtttgaatacggtgagcagctatcaatttttgattggctttttccataagttctttagcagcgctataatcactctctgctactttatcaagcgcttttgaaataaaatcccgtgcgtctcccgcattaataataatttccatcgtttcttttacagattcatttgaactttctttatcagccatattaatcaattaacctttctcaaattattaatttttagttttcttctttaataagattactgtcgtaaattttgaagaatgggtaataaatcattcctcctacacagaatagaattgcaagaagaatcaaagcactaatcgctggacttactatccatgtaacaaatgggaacgggatataccacatttgcatcaatgaatgcggtattggtgataaaccaaatttaaaccaaaatacagtaattaatggcaatacaatcccgttaatccataacggcagcatcaaatatggattccaaacaattgtcccaaaaactagtggctcattaatattaaatattgaaggaacaacgcatgcctttcctaaagcttttaatctcttagatttactccagaagagcatcattagcactaatggcatggtgcaacctaccccaccaatccaagggaaactataaatcagttcactagtaaaaatgtgcgtaatcgcttgtccgtgtgcaaattgttgtgcgttattagcaatgccagcaaacatgattggctgatcaatcgctgctaaaacccaaccagaaatccccattgaataaataaaacagtcaaaaaataggaataaagtgaatccccaccgggtatctaatgaattagctaacggtgaaaatactgctactaccagctggtaaagatcaaagtgaactaaataagttaaaatccatccagttccaactaccaggatgataggtaacatggaatcaaaccaagcaatcacaaaatctggtaatgcagtatcttcattaaaaaagctaaatttaccaaagaaccccataataattgcaacaaagccgcctacaaccagagctacaaacattcccccagctcctagttcagagaattgatatgaaataattgaacctgttttatcccaagttggattagcaaacatcagaaatagcgcaactgatgataacccagcaatgattttttgtttatttaatttcttttgctccatcacgttaaacgggaaaagaaaagcaacaaaaattgatgtaagtccaaaagtaaagctactaatcggcgacaaatctggccaccacttaaaaaaattagccggaatatcaagtaatgtaattagtgatccaacaaaaataaatggtaaaacctgtagaatagaattcttgatagtcaatatccattggttatttgcaattttctgtgctcgtggagcaaaacctttatttaaagcattcatgaacttattcattagaatgcctcctctccatttaattaaacttctgatttgatatgctcaacggccgctgccccatctaaaattgaatagtaatctggcttcatcaaaatcgtaacgaccttgtcaggcacacttttttggagtgcttcgaattctgatttcaaatgcggacccaccattaaaacatcaatatcattggcgtagtcattaagttctgcttcgctacgggcttgaattttataatctaatcctgcttttttggcagctttccgcatatttgccgccataaaacccgatgaagctcccgatccacaaactagtaagacgtttaaactcacaataaatacctccatgaatgatttctttttacaaccttagaataaagccctttcattattatttataatttagctttttcaccgtgaggggaagttttatgtccgtttaaattatgggattttctttttaaagagttgtcaaatattcactcacctctttatcaaatttttcaaaaacaaattttaaatataacgggaccttaatcatatccatactgtgggagaaaaaaataaaatctatttttatgaaaacaaaaaatccagattctcaggctacaccatcctaagtcatctggatttttgtttgtctacttattctttaacctgtcctacttaaaatactgctgcgacgacgtttggtcatcacctaaaacattgtggtgcaacatgtaaaatactcctgaagaccaggagaagtttgacgaattcaaaccatctccgtttaatgggttatagttttcacgaattggtccgcttcccgttaatccttcggcgtggtcgaatagcttttcggtttgcttaagtgcctcagaattgtagttataattctgtaacccttcgataccaaacatcgcttgatccagccaaactggtcctctccaatattgggttgccgtgaattttttgttatcccgcgaagtagttaggaaaggcatgtacgtgttaaacatctttttattcattagaacttgttttacttgatcagcctgagcactcgttgcaacccttgcccaaagcggaatcaacccttcaggacccttccctcgatttgaaagcaacagagtcgatccatctttgttactttgtaagtcgtagaagaacccggtttttttatcaaacattttagactgaatcttattttgtaattgtgaggcttcagcggtatatttttcagcatcggcggtatatcctagttcgttggcaatcgccgctaagaatcccttatcagcgtacaagtaagaatttaagtcaacggactcttggttaactgaatatccaacaactttacccttgctgtccttatctggataaactttaacacctttatcggccttgcccactccagtagcatcaaaccttaccgcattgtccattccagattcccatgcggaagcaagaattacttcttctttattaacaactttctgattgtgtttgttcttcttgtaatgcaatggatcgaccgttgcgccatattcagctaaaccgtccttattgtaatccctattggagtaccaccaatcatggtaggcaaccaacttaggatacatttccttcaaaaaagctttatcctgatttgatttataaacatgccaaactgcccatgaagctaatggtggcttagaattacgttcattccagttgattccatccccaccgcgttccttattcttgttgtagaagatggcatcagggatcatcccggcatcttgcggacgcactttatcttttttggtaatttgataatcaaacaacgccttaattgaactttccgctaactctgggtcaaactctgccacggcagcagcatgtttccatgaatcccatgcccataagccttcgaaccattggtcagacatcgaaggaacgattccatcatgttttaattctccagctgggcttatccaattggttactaaagtttccatttctttaactgctgcccgatcatacttggctttgttagcaacttccttcttacttttatcattctccgttgccttagtgatatagttattccaacgattttcattttgctggaagagggtatctacatttgcaaaaacattattggcctttgctatttcagcactcgcctctttttttgtaaaggtataagattgggtagattctaaggtatgactttcgcctggtttaacggtaggagttttatttaaactactcttgtatttgtcacccttgatactagttttaactggcgcgctgtaaaccacgttaaactgattaccagcggtggtcatataatagttatcgtttctaactttcgaaaatttgacctttaccccgttagtttctttcactaactgctgtttaaaattaaccgttttcttttcccgggtctttaacttattgataatgtctcccgtccagtacgcttttaaacttagattagtcttgccagtattttgaatgtttgttctaaccattgccgtgcggctatcagtaaaaatcagatccaaagtgaccgtcaaatttttaaacttataaacctggttcaaacggcctggataatagttaaaacttctcttagcgtccgcaaagttaaattctttattcgtttttgcgttgataatatgtagcttagaaatttggtgcgacaaattgactggatattcttcagctataatcatgggccccgggaaaccaccatacgtcgaagataccccttcttttggcaaataataagcatgctaagcaccttgatctgaaaaagatgaatacttattggtagatacttttttattctttgaatagaaatttgcagtcggattgccgcttatatctaagacatttttgtaatcttctaccgtatcagctttaacagaatatctgttttcgcttagtaaaattccgacacttagcccacacactacacctaaaaggcatttttttataaatctagaattgatcatgtgttacccctccccgtaaaaacatcaatatccctcaaaaaaattggaaacataaacttttttaataacagcatatttatctccacttgcaattagaatggcgatacattaccacattaactttaatttttttatgttttaaaacatactgtttgtcagctataacaatatcattaaagcgcatacatttgaatgatttttttgataatttaagctagttagtttttataaagtattataaaaaataccagcagggacgtaaattcttacttataattaccaatcaagtatagccattcaacatatcaatctaatatttaaaaaagccggcaatcataatgattgccggctttaaaatttaacatttactgattttacaatctctattgttgattgtagatttttgtatgcttagttatataaaaatggtgttcaaaaattgcaaaccattgtacgatttataatccaacacgtgaagcttgtcgaatcagtgtctttaaaacatattgctaatgagctttcgacatccgactcctttgttgggcgtcaactattacgagctgaacgcgattttaagccaaactttcactggcttccaggaagtaatcttgatggatgaaatcaaaagtactaaaaccgctactgatgccatgagctttaaatttatggacgccaaagctcataaattaattgatattcttccatttcgaattgtccaacaactagaaagtacttcaaacgctatgtccaaacggccagaaaagatgtcaaaatttaatttaccaacaacagtggtcgaagagccgttaaaacgaaataattttcttaacaccttcaacctgcactcgttgataagattcataacttctatctacgcttgttagcagaaaactgataaatatatcaacaatagatattgtaaagcaaaaaatcttctataaaaacactcttaaaagtggctttttaaaaaaattattaataacttttttagcaataaaaccaatggcgattgtaaaaataaagaagtaaattaaagataccaaacttcctggctctactatattccgactaaatgcctgaataagatataactcgtaagaaatatcaccaatcagagtaagaaatttactattaaataaaactgtgtatcttacagataaccataatacaaataaagttaatggtagaactgtaaataaagatactgtattaagaactatatatggtgctgcttttaagaaatgtaactgcgttaatgcaaaagtaaaaaatcctaatgcacctaacatgataaagtatttagagcaattcctgtttttgaagattttcatagctttattcttttgatttgaaatcaaaattcctaacgggaaagaaagcatctgtctagctcttaggaatggatctgctttcattgcaaaaaacagcgtatcaataaagaaccaaactataaataaagccaaaactatataaaatttttgcattagattaaggctataatgttcagcaataacgctagatacccaaaaaatgatataactaattactatgtattggatataccaattcacattctgcattagtacaatattaataagtcgtttgagtgatagattccccattataaaagtagcaactatgtaaacaaaataaaatggaatcaatacaccaataattcttttagtccaaaatttattcaaaccattttttttataactttcagttaatccatatccagaaaaaattaaaaaaagcgcgacacctataccagcaatccattgaataccgcctataccataattcattcctgagtgtgcccatagtacagttagaatccccacgcctttaagaattcctgtttgagatctcgaaaaaaaactgtcataaagatttttttttgccgaaaaagcatacacacaacaaataattaaaactgtgtaaattaaaaaggttaccaccataaaaacctactttcaaattttattttttaaataaaaaactaatttgggagccctcatattcattaaaaatataatcttctcttttaagtttaaatttgctttaattttcttataggaagtatttaatatggctttataatcatcaacaaaagctctatcaaactgataagtcaccattaatctaaaatatcttgcaccttctacaataattcttttatataagaaatttttttctaccgtaaagtctggtggaagcatctgtattgtacgcttaatagcaaaaatatccgtcacccttttttgaagagtttttttgctcatcatcctactaacactatttttcctataaacataattataagtcgcgtttttctttaatacacctccatctacttttagtagatactccatattaaaaacaaggtcttctccatagtctaaggattcatcaaacgttatctgattatccctgatgatctttgttaaatacatcttattccatgggaaactataaataattcctggttttagtatctcgtcaatcaattgctttttatctaggacaatatctttatcttccttaaaactatcttgaactttattttgataaatattatttcggcctgatatagccaattgcccataattcatgccgtcaaccatattttttagatgatcaacatgtaaaaaatcgtcgccatcaataaacgttataaactttccttgtgcatttttcagacctaaatttcttgcctttgatactccagaatttttttgataaaaatatttaaatctaaaatcttcatttacataaaaatcacatatttcttttgaattatcagttgatccatcatcaattaatagaacctcaaaatctttataagactgacttttaattgaatccaaacatttatccaaatatttttctaagttatatataggtacaactatagttattttttctgtcattaatcctctctctttttacttctagattctgttataaaatctttaacaacagttataaaaggcgcccttaaaacaagacataaaatcacataaattaaagcccctgcaactacctcggttgccaaagtaacaatcgtcatagtaaaaatattattaagataccttactatcaaaaacataatcaaaccagataacaagtatttccacaatcctttaaatagcttgggaatttcaatttgacgtctaataaaaaatagttgcaatcctgtagaagttatttctgaagctacagttgctatagtagcgcccataaccccaatagaataaatgaggggtacattcagtaccaaattaactagcgcacttatgctaacagcccatgtatactttcctgtttgattggttggtattaaatattgatttccaagcattacaccccagcctattaggaaaataactgctgattcaacaatcataagattccctgtaattgcaaactcctctcccataaaccaaacagaaaatttaggagcaatagctgctaacccaaacattaagggaatagataagaaattaataaaatcaccggtagtatacatatactgttttaactttccaaagtctctactagcatatatactagccattcgtggcaacataaccgttccaattgacgttacaactgctaagacaattttcacaattctatctgaatactcaaaatagccagcacttttaactccagatatgctccccagcatagttttattaagtaccaagtatatttgtatagcaacctgtgggataaacaaagatattgacggtttaatatgcttaaagattttaaggtttttaaaatctggtttacttatatacctttttaaatacccccatagcgataaattaccaaccaaaagagacaagcttagtattagtatatacgtgcctaaatcgttttccgtcttcaccatcgtaaaaatacatactaaagaaataatttttactacaaagtttcttagaacggtaattttaaagttttccaaccccataaaaagccaggatatatcgaacgctgccgcaattatttgaaatgactgggcaaagaaaaatccgtgatactgactcacaaaattcaagtatattaaaaaagcaatataagagattgctattgtcaaaaatctcaatatcgagatttcccaaaaatcttggctaacatctcttgcattgcctctactataagcaatctggcgattaccataagtgctaataccaatactaccgaataatatgaaatattgaattattgagttggtatacgcattaataccaactccttcactcccaagaactcttgaaatataaggcgttgttactaaaggtactaataaaataaaaacttggtaagaaacgttaaaaaggaaattttttactattttcatcagagattatcctttgcaatactttataaaacctttacctaaattcatgttcaaccgtctgtaaagcagccataatcgtttggtccatgttgtaataacgatattgccctaaacgaccaccaaacaatacacttggtgctttttccttagctaactcaacatacttggtataaagctctttattacgtttgttgttaattggataatatggttcatctccacgcttccaagtctttggatattcatgagtaaccactgttttacccttattacccttaccaaattcaaaatgtttgtgttcaataactcgagtatatggagtttcagcatcagtgtagttaaccaccgcgttaccttgatagtcatcaacatccattacttcagtttcaaaacgtaaactccgatattctagttcgcccaattcgtaatcaaagaattgatcaatcattccagtgaaaataatttttgcaccagaatttaagtattcttccttgtgatcaaagaagtctacaccagtttctacctcaatcaattcatgatccaacattttttcgataatttgggtatatccgccaatcggaatcccttggtatggatcgttaaagtaattgttgtcatatgtaaaccgaactggtaaacgacgaataataaaggaaggcaaatcggttgctgattgtccccattgcttttcggtgtaacctttaactaacttctgataaacatcaggaccaaccagcgaaatcgcctgttcttctaaatttttaggcttaccctcaagttgaacgctcttcttttgctcttcaatctttgccttagcttcgtcaggagtgataaccccccaaagcttgttaaatgtatacatgttgaacggcatactgtagatttcaccattatagttagcaatcactgtattaatgtaattgttaaaatcagcaaattgatttacgtaatcccaaattttcttcatactagtatggaaaatatgagcaccatattgatgaacttgaattccttcaacttctttagtgtaaatatttcccgcaacgtgatcgcgcttttcgatcactttaactttatgtcctcgttttgccgcttcgtgggcaaaaactgagccgaagaggccagaacctactaccaagtattccatagatctacactccattgttttaaataatttatgattggcttaaatattcctcattaatatcttctccgggtactaagtcatttaaccccttgctattaaataaagcagcatacattatcaaaaatacattataaaatggctctattaattctgggtctaacaaaccatttacgataaccataaaaacagcaacacaaagtatcgtattttccgtttttaaaactctgtattgaaacataattgtatatacaaggaaaataattagagaaattaagccgaacctcaataaatattgtaaaaaagcactatctacataaaagtatttttgcccaattacattcgtactcgtgttaaaaaaaatcttctttccgattttatgaatcccaaacaattctagtgactcatacccataagaaattcttcccgaaaataatttatcaaattgataatattttgggtaatttttactaaaccaatagatgactaatgtaagtacaggtgttaataataaaaatattcctctaaacactctattatgcacaatattaaaatgaacatacttatttagataaacaaaaatcaagaaaatagttatcaatataaaaggacttctagtatttgtataataatacaacccaagattaatcattcccaaaactaagatctctgcaatattaatttttttacctcttaaaattgcataaaaggctactatatacaaaaacgcgtgaactggccacgttgcccatacgaagcctaggttatctcgcacaaatacgtccctatagctaacactattaagtataaaaccaaattttgctaaaagaacactactaccgtaaaaaacacataaaaaaactaacactatttttaaaaacaatctaaaattaatgttcttagctgcaaatataaatattgctactcctatccaaatagtaactccagccacgtaaccattattcaaagcaataaacgctaacgtaagtacccctaaaagaaaacgcctaacttctaatttaatctttaaatccataagaattataaaaaaggcaataataagccctccaaattttaaaggcttaatcactatatccgaaacgttactaaattgttgtaatcgagttataaggtaggaggatagccacattatataacctatggagaaaaaaacagttttcgtcaaacaactagatgctcttaacagatttattctttgattcataaatacccccaaaatatttacttgtaatttgtaattacatttatagcattattaacggctttttttgtaaaaaaaccatctcttacttttgtagccatttttcgtgcatttagaacaaattcctcatattcgttatcatttaaattattaattttatcatctagttcgtgtaagtttgatacaactaatcctaatttgtttttagaaataaattttgccagcgcagcttctttccacatcactataggtaaaccacaacttaaatataatgatactttatgtggattgttgaatcttgtgtactcaccataaattccattattagtattgacagagtttccatcccatactaagccaaaactccccttcagaaacttaggcagttcttctggactttttacgcccctataatcaatcttctctgaataattcttactaggactaattccgaataatgttagctttttattaaaattccacttttctaaaaacttggatttttctaaattcccagcaaatattaaattatcttttttactcacttcggatatatcattatcatttaagtaatcaaaaagttccaaagaaataatgggctttgtaataccattttctcttagccagttagccattatttcattatgcgcaattaaacaatcaaatttttctaatccagaaagttcttctttaattttttgagggttatttttataaagccgcaatgactctaaatcgtgtattatgcatattttttttatttttcttctactgcattcattaataataactctagtagttactctgctatacattggatattgcataacaaatatgtcatcagctttaatattcttaaatttatttttaacttcaattctactaaacaaaaatttcataagcctcgatttttttaacttaatttctacattctcaaagccttgttgatttaagattttagcaatatcttctttagctttttgcccagcagtatttttttgcccaattgaaacttgtagtacatattttttcaaaacgagatctcctaaatttcatagcttgatttattcgggaatgctttttcaaacatattgattaattcttccatcttttgttcataattttggacatcaaaatcatcattaatacaaagaactttatatttatcattattcattactgtttttaactcatcaaattgattcaaggtatatattttcccaaaattggaattttgtggttcaaagtgtccttcctctatctggaaatacctcataagccactgattaacatcgttaggcgttctaaatttatttcttgatgtctcttcaagaatgtctttttccttatcccacacttcttcaaatgtactttttaaaaaggaagatgttaagtgcgaattccaataacctaatattttcggccatggtagcgtaactatatttcttaggattttagcaccataaaaaatattaaacaccttaaaaaaattatttttaatatcttccattttattaaaatgtttattaataatcctcacatcgttaaataggatatttgaaaaatctgtagacggaattgtagggttatagatcgcaaaatctcttggtaacccttttctaaagaaatctccaggacttgttttattcatcaggaaaacatcatcgttaaataaaacaaaatgctcagataaaccttttattttgtgaacatttaactctattgcatttgaattgaatgtcggtaaatagcgttcgctcataaagtcagaatgtttaactaagcatagtttctcattatttaaatttaaccactcaggataatgtccttcagtaactaggtaaactttatttacccatggagcattttcctctattgctctaaaccaatatttaaaagtaccataatctctataacgtatgtccgtattcattatttcatcactaggactatatttatttttttttcgaagccattttgggtcgctcccatccacccaggtaacaacaaaatctattttcatttttttcctcattataattctaaaatcttcaagatatatcccgcatctcttctctcgtcgaagaaaaatttgtttttgatctcttctctgagttttctatatgaatcttccttattagaaatctcgtaagcaacgcgaaaaagatcatttttattttcaagaatttttccagctacaaattcagatagcttataattaagccctctagaagtcgaatagtctttcaaatcttcaaaaatgtagtaaataggtttatcagttagtaaataatcaattgtaactgatgaataatcagatataagagcatctgttttagctaaaaatgtgtataaatcaaaacctttattttttagccaatcctcatcaataaaaataatatttgaaaaatcttccactgaaccaatattatcagtatcttgcaacggatgtaattttatataaagccgcgtattttgaacttttaatatactatctagtttttgcaaatcctctttactctttaaaagaggaacaataaactctgttgaaccattactcgaattaagtttgctcgacatcctataagtcggtaaccatgcaattgatttttctgttcctaatgtttgactatctacttccataagtggcttgtttctaggggcattagctataagaattttatctttttcaacgccaaaggatttttcaagtatgtcattaaaaaaaggagaatacgataataagtatgtaaaatcatttatttctctattatcataacctacttccagcttccctattttttttagtggcattccatgccataaattgagcactttttgagaactagcaggttttattggcatacttccaaaacaatatacaaagtactttgatgtaagataataccaaagtacttttaatttagaagtcacatattttacatttttaatattgtcctcttctactcccattaaatcattagatatgcatactatagttaattttttattgtactcattctcaacaagatatttatacaaatagaaaacgttatctctaaacccccaatttgaatataaaactattcgtttctttttcggtataatcttattaaccaagctaaaaaaaaacttaaacatcacttgaaaaaggggattatgtttaatatccaagttattattcctccattaaatcagacactatcttctgcaatctctcattaaactcagagttatgtcttgtagttttttgatcagtatcgctcaaagaaatttggttattttttagattattaattacctcagccaaatcctcaatgtcaaatacgggaaataacattcctttaaatttatagctgattttttttaaaaaatcagcctggtggttattaacgtgttccccaaatttctctaatcgaggaacaactataacttttttatctttctgaattaccgataaaaaactagacggaccaccatgagtaattactacgtctgccttatctatgtatttattcatttcatccatggataagaaatttatagctgttgcatatttacatttgtatgaagaatagccaaactgaataactacatcctctttgtacttgttagcatactcatccatatatcgtactaaacgatcaaattgttgctcatgtgttccaactgtgacaaaaatcatcaatatatactccctaaatttattgatttcggatatacctttttcatttcttcccattgaacaataaatttgtcagtgattggatagacaagctttcctgtaatagttgatttatcaattctatcgaaaacttctacataaatggttttcgcaccaaataatttacccacataaaagaaaggtacggctactgcggctcctgacgaaattataactttaggacgttccttggctataatcttgaacgctaaaaaggtattttttattaagttctttaaatttctatttgttgggaagaaacagttatactttttttcttcttttaataaactattcgcgtcttccttattaaaagtaacccaaaatctatcatactttttccaagtaggcttcattaaataaagatgtgctaaatgtcccccacttgacccaactaaacaaatttttttattttttaccattataatttctcctagtaagccccatttggcttaaaaattataccaatagtgcgaaaaagtatcgttatatcaaatagaattccactattttcaatataattcagatccaattcaaccattccatcaaaatccacatcatttcgaccactaacttgccataatcctgtacaaccaggttttacggctagtcgttgacgatcatactctgaatattccgcaacttcccgttccagcggtggacgcgggccaactaaggtcatgtcaccaaccaaaacgttccataattgcgggagttcatccaaactatgtttgcgcgtgaacctccccaccttagtaattcgaggatcgtgtttcatcttgaacatggccccatcgacctcatttttttcaagtaaatcttcaagctttttatcagcatcgacgatcattgatctaaatttatacattttaaaaggccgctgaccttttcccaatcttatttgtgaataaaaaattggtccccgatcttcggccttaattgctaggctaattattaaaaataatggggataacaaaattaaacctgcaccacttgcaatgatgtctattgctcgcttaaaaaaatgataaataaaacgtcgattttgatattgctcatcaatcacaatttttttattttctgtcattttaatctccattttagaacaaccagaacctctttttctttctttttttaacttccgatacgtgcaggatatcgtccgtagcaatcgagtccccatttacgattgcctttgcgttgtagttaaaacttgttgcctttctttcagtagttttcttcgttaacttattaaatgcgtcccgcattaagaaccgccgtcccttaaaattatgagcgtcggacgcaaagataaaacctaagttagcgtcaatgaagcgttgcgtcagctcttcgacgtgattgccaaacacgcccaggtagctgctactggtcaattgcgataagcaacccatttcgatgaaatcgtataaccgatccggattcttttgaaatccgtggtttcgttcaggatgggccagcaccggagtgatgccccgggcaattagctcaaagaccatgtcttctgcgtactctggaattccgctgtgcggaaattcgagcaacagatacttacccgcttcatccataaataagatgtcgtcttggtcaattgcgtctaacaattcaccagtcaaatgcacttcttgcccgggaaaaaccgtcaacgtaattcccgctttgtctaattcagcttgaaaagcatttgttttagcaataacgtcttttttatgattggtgtacattccgtccatgtgatgcggcgttaataaaatgtgtgaaattccttgtttaaccgcctcgcgcgccatgtcgagcgccatcggtaggtctttcgcaccgtcgtcaacccctggcagaatgtgacaatgtaaatcaattaaacccatgattacttatcatccgttccataataaccaccatagtaaccaccgtaatagccaccatagtaacccgttgatttttcagcagatgcccggttcaaaatggcacccaaaatgtttgcgtgaaccgtttcgagcatttgtttagcgtgccgaacgcccgctttatccgcgattccttgaggcactactaaaacagtcccgtccgcacgtgcagccaaaacttgtgcgtcggtaaccgtattgacgggcggtgcatcgataataaccaagtcaaacttggtggtgagcacccctaaaaggttaaccatcttagatgaacctaaaagttcggatgggttaggtggaattggaccactaggcattacggaaagattttccactaccgtactgtgaattgcgtcatccaagctaccagtgccagccaataggttacttaaaccaaccgcgttgctagttcggaaagtccgatgtactgttggacggcgcatatccgcgtcgacgattagaacacttttgccttggtcagcccaagttaccgccacgttattgctgacggtcgatttaccttcagatggtgccgaagaggtaaagacaatcgattttaattgcttatccactgacgagaattggatgttcgtccgcaccgtccggaattgttccgcaattgtggaagtaggatcattataggtaatcaatccgaccccattttttagactttcattatctagctttggtttcttcttaaaaaacatgcttatcacctagacccttctgcgcattctagtttcgccatcatcacggttattgccaccaatcttaggcgcaatctttcgacgaatttcgttctcgtcaatttcgctaataattccaagccccttcaaaccgagttcctcagtaaggaattcttctgaagtaaccgtccggtcgctaaattcacgtaagaacgccaatccaactccgagcaagaaaccaattacgattccagccgcgatattaagttttgtccgtggactaactgggtcatcgtctggagtagctttagaaacaatcgaaacgttgttgatgctcatgatctttacaaccttacgcttgaagaccttagcagtttcgtttgccatcttagctgccgtattcgggttagtgcttttggcattaatcgagaaaacttgggagttttgttgactactgattgaaatggagctctttaggttatcaacgccgctcttgtaacccggaagaccggttaatttttcgtccgcctcacgtagaaccgttggactagtaataatatctttatatgtattaatcatttgcacatcggcttgggtttgttgtaattgtgcgcccgccatgtcatccgacagcttccgattaaccaagatttgagtagttgcgctgtacttaggcgtcatcacaaagaacgtcattagcgcagccaataaagtaataataaacgtgctagcaaaaattaatccaatatgttttcgaagtatggctaagatttggccaatactaatctgttgtgtttctgcagtttccatgaaatcctccgaaagttatcttaagtagtcaaacatatttgttgaaattgatgcgagattatcttccccattaacgtaattactaaataggaaggttcccgtttggtccttcaagttccattccacacggttacgcccgcccgcaattgattgggcaaggctcagtgagtttccatcaactgaaaagcccgctgcgtggtcgcccttagcatccttgaaaactttgtccaaggttgccggagcaacgtaatcactattgaagagataattgaagagctgcgccatgtcgctaggcgaactaactagctgatctttaccaaggcggttgattgctttagtgtccaagtcgtccaacgaaaccttcgtgccgttgagcgagtcgccactctcgtagtagtcaaccgtcttattcttcaaaccaaacgtggtctgatcaagttcgagctgatccagcaagtcttgaatgaccgaccggtaactttggccggtcaccttttgaataattgctgcttgtaaaatagtgttaactcttgaatcggaatatgtaccttcacttgctgaatcgtacgcagcgtccgcgttgaccttcttaatcaagtcccttgccgagctgtccgccgaaaagtcagcggatgacaaccccgaagtctgattcatgacttccttaacggtgattaagtccgcaccggcaacgtccttatcgtacttcgacagcttgtcgtttaacttcaccttgccagtgtcaatcaagtgcatgatgaccgcgttattgaccacgtcttgtattttccccatcacaaaacgactatctcgcgtcatcgtaattttatttgcgtggttgccgtagccacgcgaactaacgagaattttcttacctgtatttaatgctgctgaaccattatactcgccgttgtttaaaatcgaatcgaggttagagctcttcgatactttaagcaaatcggacgaagatgatgtggtacctgaactacttgcggagtcggattttgaccccgtgtacttttcgataaagtgcgtagctagagaatccttattgactaaggtcaacccaaagccggcgcccgcgaagacgactaaagaccctactgtaacccctaaccacgttagcgtttttttcatacagtatctctccattttcaataagtcacaatttaatctatcatttaacagggtaagtttcaactgaatcgcacccagtcgggtacaatatcacttaatttacttggttttgtaactccgttgtaatcttttgtaacaaaaataaagtgcgcagttgtcgtcttaaactagttcacttggcacctcgcaacctactccctgagctagtttagacaacgatagccattatacacaaaaaacgactggaagaacatatccagtcgtttatcgattgcgcaaaaacccctttaaatcaagggttaagtctcttagaattttcttgctaactactcgttttcatccgtttgcttcccataaatcgagcgcaagccgttcaagtcctcttcacttaagccttgctgtccccggtcaatcggatacatgattgaggtcaaactttggctgtggtctaaccctaacgcatgccccagttcgtgaagcgcgaccgattgagaaatcgagcggttataataaatgtttagttttgccgaggcgtggttagcaatccggctaacgaccccctgttgttcaatcacgtcggggccgcccacccctagttcaatagttcggtcttggttttctggcatggccttttggtaaacgccgagcgtcacgtggttaagccaattgtgcatcggtccgggttccagatccacgattcccgtctggttgtactgcttgattgcttgttgaaagaccttttgaacgttttctggcgtattcggcgcgaaactgtagtaataggtcttcgacaaattctttcccttcactaccgactcaaccggggttgctttcccgctcgcctgatccgccttagtcgctttattctggttaaagttccagttggaatcaatcaccgaatctaagctggtcgccactttattaattcccgtacggaaggtttgctgaacgccggcaggaatcgtcaccacgtcgcttttaatcaaccacgccgcaatcccgaaaatcaaaagccatccccaaaatgttctaaaacgcaaaaagcatcctcctagcgcgattagtttaagttaaataacgcatcgctttccaatccgattgaagatttttaccttcttgtattttaaaacgatttaggttctaactaaccaaaaattgcctcacctttataaaaaactaagcttcttggtaattttgcaatactttgaggaactgttcgccatatttggctaatttattttctctaatccccttaacgtctaacatttcatccaacgtttccggaagcaccgcgcacatgtcacggagagttttatcagaaaagattacaaacggcggaacgtgttgttcttcggctaaatcacgccgcaactgacgcaactcttcaaacaaggcgtcgttagttggcaatgatttttcggctctgaccgccactttgcgggttacccgctgcttaccacgcaaaatatctagtccggctgcagtatttttcaagacgggatattggccgccttccatcgcgattattcccgaagcaactaggtaatcgatcaactcggtaacttgctttttggtcttttgcttcattagaccgtacgtcgacaacttttcaaaatgaaactgcttgacgcgctggttttgcgaaccggtcaatacgagtgccaccatttctttcccaaaccgctcgcccattcggtgcatgcacgacaaaacttgttgagtttcaatggtgatgtcttgtgcttcgcgagtgtctaaacagttcccgcagtatccacaatccggaccatcttcatggaagtaatttaaaatgtagcgttgcaaacacatctgagtgttgccatactgactcattgcctggagcttctggtattcgacttccttactttcctcatcccgttccgagctttcaatgtaataatgttgaatttgcacgtcccgtaacttatatagcaggattgcttcactaggcaggccatcccgaccggcgcgccccgcttcttggtagtacgcttcaatgctgccaggaatctggtcatggatgacaaaacggacgttactcttgtcaattcccatcccaaacgcgttggtggcaatcatcaccggcacccggtcgaaaaggaagtcctcttggttttggcgtcgctctgccttactaagttgtccgtgatacatcgtcacgttgaactttttcttagttaaaattcgatggaggcgctccacttccttaaccgtgctggcgtagatgattccggactggtcctggtttaacttgaggtagtccattaagaagcggtcgctatcctggttcttaaccactttaaacgccaagttttcacgcgcaaagccagtttgaacctgttcggtaattcctaaacgttccttgatgtccgtggccacccgcggagtcgccgtcgccgtcagcgcaatgatcgtcggacgagttggcaaatgttgcactaggtcggtcaagtttaggtaactaggccgaaaatcatggccccattgcgaaatacagtgggcctcgtcaattgccaatagatcgatcggtaaggaagccagctggtcaaagtagtcggaatctaaccgttctggcgaaatgtacaacaatttcacctgccgattacgtgcggccgcaaagcgttcgttaatttccatgtaatctaacgtactattaatgaaggttgcgggaatgccgttgtccaccaaggtatcgacctgatctttcattagcgaaatgagcggtgaaaccacgagggtcaatcccgactgcatgagggccggaatttggtagcaaagcgacttgccgcccccggtgggcatgattgccaagacgttttgccggtgaagcacggcgtcaatgacgcgcgcttgccccggccgaaaggtatcgtagccaaagttagattttaaaacggtttgtggatccatcgaatgcctctttctttttgttgatagtagttaagtatagtatgaaagattagagaacggaagccctcgggtaaggatcgaggattaacgtaaaccagccattaatcgtgggtttgacgattgatggctggtttgggttaaccgcagagccttgagggctgaaactcgttttcgattgagagaacggaagccactgggtaatctttgaggattagtttaattttggaattaatcgcgggttgggcggttgattccaaaattggactaaccggagaagattggtggctggagttcattttggctatgccacagagaacgcccccaccaaaaaaagcggaaatccgcaacgcatgatttccgccttcattttgaagtatgctagttttaaagtctttttatttctaccgatacttccaatccttttgcgaatacgcctgttcccaaaaatcatactctaattcacaactacgcaaaaagcgatgggtaatttcttctttacgttgggcacttaatttaggcgcggcttcgtctagcatcgcaaataactgggtaaccgaatcgtcgccagcatcttcttcgtcaccttggtagaattcaatccacggcaagaaggggttgtcaggtgcggcgttttccacaatcgcttgactgatttcattgtacgtccacgggcacggcagcacgaccgctgcaatgtctaacaaatccccttcgcgaaccgccgtgaataaatgctccgtgtacaacgcagttaatggccggagttcagcgtgctggtgctcggctaattcaatgccggcgatgtcgcataaaatctggtgggccgccgactcatccgcaagtgaatattgaatttgttcgctgaaaaaacgcatccgttccttggtttgacttttcaccaacgcaccggcaaaaaccttcgcaaaggcgttcaaaaagcaggtgtcctgctccacgtaaaccgctaaggctgcgcttggaactttgccctcctgaatcccctgcacaaacggatgctgttgaatgtcgtgtaaaattggttgggcagcttgctttatttcttcggagaacatgctgcacctcctgcttgggcgaccgtagctttaatttcagcaatttactgagccggatcagtcatttgaataaacatgctgatggccgcaattccagtcgcgccagttgccaccgtttcagcaacgcgttccagcgtgattccacctatcgcaacgaccggaaagttactcatctggactaattcacgtaatttatccactcctagggcattcccagcatcggctttggagttagtttcgtagacggttccggttcccaagtagtctacgccgttcaactggttggcagcggtgatttgcgccgcggtattgcacgaaagccccacgatcatttggtcgccgactcgttctaagaccgaggtaatccgttcgtctttttgtccgacgtggatcccttccgcccccacggccaacgctaagtctacgtcgtcatcaataaacagcggaatctggtatttttgggtaatctggtgacaagcccgggctagttcaactacttcgtcacgactagcggttttcaccgcccccttgttacgaaactgaaaggcagtggcgccggattgcacaattcgttccaccgtcggtaagaagtccgccttgctaaccacgtcctgggtgccagcaataaagtacgcttgtagcatggttggattaaatttcattttcaacctcccgatatgcccaatggtttaacgggccgtgcccgtgccccacctgaattccgtcactaatcgcggcgttaataaaggctttgccgatttgcagggcttgttttaaagatttacccttcgcaatttccgacacgatcactgatgaaatcgtgtcgccagtgccgtgggtgttgctggtttcgtaacgggggctagctaactctaactcgctaccgtccgcgaacagaacgtaatcgcgactttttgctgaatcactaaaatgaccacccttaatcaagacgttttgtgcgcccagttcctgcaaccgcgcagcagccgctttggcatctgcgttatttttaattggcatccccgctaatttttcagcttcggggaggttcggggtaattaggtaagccagtggcaacaaccgggtctgcaccgcttcgatggcttcgtcgctcagtagtttcgcgccgccctttgcaatcatcaccgggtccaccactaaaggtccaaaatcatacttttgatagttttccacaaccgcgtcaacaactgccgaattagccagcatccccgtttttgcagctttaatatctaaatcttcatccaacgccgcaaactgatggtcgataatgtggcgcggcatcaccgccacgtcggtcacccccagcgtattttgagcggtcaccgcaaccaccacgcaggtcccaaaaacccggcgttcctgcatcgttttcaaatccgcttgaattccagctccgccgccgctatccgttccagcaatcgttaaaacttgcgctggcttttttgtatccatgacaatcattcctcaactttcattctttcttcaacttgggcaaccgtgatgtttgctaattcatccatcagcccgttcaaaaaacttcctggcaaatactggtcgtgcaatttttcggtaacccgttcaccagcgcacgacaaggtcaaacttgcgttaattgccgcctgcaacggcgttggtccgatcgcacaaaatgcggctgctaaactcgaaagtaaatcccccgagcccaccaccgccggcaaaagtcgggtttggttgtgaatcacgaccacccgggttccgtcactaatgtagtcggttgccccactcgcaatcaccacgttatggtacttttgtgcgcaagcttttaccacttgatgtgcgtccccgtcgccgttccccgcatcaattccgcgagtttgccaatcaattcccgctaatacggcaatttcgcctaaattaccacgaattacgtcgaagtgatactttttcaacaaccggaagtttaattgctggcggtactgggttgctccgaccgctaccggatccaaaacgagcggtttttgttggtcgttcgccgcttggcacagcgtttcgatgtctgcccagccttctcgacgtaccgctccaaggttaatggtcaccgctgacgccaagcggaccagttcttcggcttcgctttcctcttcactcataattggggaagcccccaccgcgtttaacccgttcgctactaaaaacggggtcacaaaattggcgtagttaaccaccaccgggttaacctcccgaatttgcttaattccttgtaaatccatttgatcagctcctcattcatatctcaccaagcggtgtaccgaaggcggtcgctaccagcgaaccatcgctgcagattgacgaccgcgtttactaacatcctccatcggcaaccaacaaaaaaaccatccttgagaaggatggttttcgcccaataaacactttccttcgcaagtatcaacttacaggttcaaagggatcacgctgcacaagcgcatctcagttcttctaagaatacccctagtgtagatattattttatttgaatatgaattcggtttcataatacgccttttaacccccttacacaagtccgtgagcatataaattcacttttaagggcgacccctgctaaaataaagatgtacaaaaatattcaaagggggataatatttatggataaagacagaatggaaaacactaaggacaaagttgcaggtaaagtacacgaaggtgctggtaaattaactggcgacaagaaggaagaaagcaaaggcaaagcgcaaaacatggcgggcaaagttaaagacaagcttgctgacgtaaaggattccgctgccggcgcaatggaagaattaaaagacaagttagacaagaaagacgataaagatcacgaataattaaaaaaccgcaaattgcggttttttgtttggcctaatcacgtatctggaaactaactaaaaacagttctacatcctgagtcttcattcatttcaattttctacatacattttaatgaagcttttttttagtggtgctcaagcccgccgaataaaaacggttaaaaacatttaggactttagcatcaaccgcactaagaaaactggtttatttcaacataactaaaaccccaccaatcatctaaaccatgattaatggggttttattaatgctcacaaactatccgactttggtcccactgtttgtaacatcttccatgaattattgaatattaacatctgaaacttggtaaaaggcatttgccgtattagcaatattccatacgcttaggatcacgtggtatcccttttggtccggaatgttaattttgtgcgttacttcggttcctggggttgccccgtgatcgtcaaagctagcaattttcttgaaatcactgaattttaacggcttattcgggtcccagcctggtttggtaatgtagtaatcccacgtactggtactgtgtggagcggttaggtgccaggtaatatcaaaggcaccactcttaatcggcgtcttgtaccaacgatcggcagtttgctcgtctaattgagaaaaattagcaagccccgcactcgcaattttgccatcgataaaggtatttttcggcgcttcgatactttgcggttcgtacattactggtccaatattttcgttcaatggtttaccaggaaattcactacttcctaaataagcccggccgccaggattagtaacgtatccgtgcgcggaagccttgataacgctaaaacctaatacaacaattacaacactaacagctactaaaatataatgtaaaattcggttcctcgactttaccataacacatccctccttatgtctataagataacatggtggaaaattgcgttccacaaaaacgcttacacaaataaaaatatcggtaatcgttgatggtctgcgtaggtggtgccggtcagactcgttgcccggtacaatgatgttctttaaaaatcttttccaggataaaaggaacttcaaatcccttatattgcactctcgacacgcttttataaagccaaattcatcatcttagttgacacatcttatgcaatctccacgattgcctgctcataaatcaagccacaaaaaaactgggcaaccaaaacttggtaaacgacctcgttttggttgcccagtgaaaattaaaatttaactgccttttagttatttccatattgtccgcgctgatggcgatttcgtttggctaagtcgggatagctttgaaatagcttgcgcaactcagcttggagttcgggatcgttgcgcttacgcccgtgtccccggtatttcttcataatttcgcgttgtttcttccttaactcatgtaaatcaacgttattcgcactcaagaactgatcctgttcagcttccggaagttccgtaacgtcttggaagtccgtataatcgtgccgggtgaccacaaacgaaaagaccggaattgccaaatagataactacggcccacttcggatagaaataggctaacactaaaattaacacgctcgtgaagccaagaaagttgttgtggttatcataaatcttatggaaaatccgtctcatttcgtggtggctagtgtacttttgcttgataacttcatagctgagccacataaacaggatgctgacaatcatggtcaacaccccgtacgccattacggtagtccgattagtgtcataaataatgactttggtaaaaattggcgtcagacttaagaacgccaaaaaggtaaactccttaacgaaaacgcggtcgttcatggtatcactatccttgaacaacatggcgtgttggtaccaaatgttggctacgaaacaaaaactaatgaagaaaataccaatgcttttcccaaattgtaaatattcacttaacgcatcgtgttgcggtaacggcagctccaacaccatgatggtgatgataatggcgattaccgcatcactaaacgcatccattcgttccttcaactttttcaattgctcttttcatccctattccacgtgcttgccatcgatgatcaccacgtcgatgtgctttgccacgcgatttttttctggaggcagttccatgtagtctccgtacatccgggttaaaattttatcataatgcttggggatggcaacctcaagattttcaaacttatgcttggttaactcggtgagttcccgttggctcagaacctctttatcgtaggcgtattgggaagcgtagtttttataatggtgaaacggttcgtgattatacaaccgcatgatgttttctcgccgttccttcagctttgcaacgctcatgaagaggtccaagctcttgtccttaggatccttacgaaacggcgtcttgatgacgttataccctaggcgcagtagaattgccgtatccgcgattttgaaccggttataaaccgcttggcgaatttcaggttggcgaggaaccttatcaaacggaaaaatatcgataaagattcccttccgcgcgtcgttgacgttatttttctcttcaatataagtattggtatctaaaatcttcatataactaaacgcaaaattaggatccgtatccgcagtttgcataaagtaatgggtatgttggaactcaaccggcgccacggttgcaaatttatcataattttcccgggtcatccccaagtcgacatcgtcgtcccacggaataaatccatcgtgtcgaatcgcgcccagcaacgtaccgccaattaacatatattcaatatcatacttatcgcaaatggtcgtaaccacttgcaacatctgcaactgcacccgatgcagttcttcaatttgactcatggcgtcccttcctttcatcttctagaataattgttacatttaaggattggttaagcaataggcaaagaagtttgatttttttggggaatgtaatatgataatggcagacgggagggagtttttatgaaaccaacacaaaacaatcttttaggttatctattgaagaatttacagaattcagaattagttgaacgccttttacgcaacttgcagggccaacaattggcttaccgccccattccgattgaaaataacaagaaacgtcggtaaaatagaacgtatgttataatatttatgtaacatgatttcggggtcgttatggattcgacaggtatgggtcgaactgtaactgcatttcgtaggttacgtctacgtaaaaacgttcagtttaattataactgcaaaaaataataacaattcttacgctttagctgcctaaacagtagcttagcgtgatccgcctagcctcgtccacgggctagtaacgggtctcaaaaagagtggacttgcgcttaaggattggcctggatgcttaagaagaggatttacagactagcgttttaatgaggccctgacatacggcagcttaattcgcgaatttaaatagtatggatatgaatgtagaggttacagtggcgacatgcttggacgcgggttcgactcccgccggctccatttttgctattccttcccgttgtatacagcgttaaaacgttgatatgacgggatttttttgtacttctaaatattcatgttttgcttaaaattgcacagaattgacctaaaacttagccaaaagcttagccaatttttttggtacttattcctattatggcaaggtttaaagcacttattttttacaaaaaattctataaaacttagccaattttagttatttggcctcaacgtaatcttcaaacctctgcaaagctgctacattctgttgttctgtcgtatgagtgtacacgtcgagcgtaacgctactgtctgctcttgagtgtcccaatctctgttgagtctccttaagacctactccagactgatacagtagtgaggcgtgtgtgcctaaacccgtgaattgagatgtgcttgagtcccgtggctttaatagctttattaagccatttggtgggggtattcatggagcgaaaatgatttctattgcttgcgaataccaactgactagcattgttagtgttgaaccccatccccagaaaagtctcacgttgagcacccttccactgcctgaggtatcgcatggtactgtcatccaagtcgattgtacggcgtccagccctactctttggaggttgcacgattaacttaccacctaacccttgcgtaagagtcttgttaacccgcaacgtgttactttcaaagtcaatatccttccacgttagtgccagtaattccccttttctaataccagagtaagccaataatctgaacatggtgaattgttctaagtcccttttgggggtcatatagtcgaaaaaggtattcagttcgtctctagtccaaaagttttctagcttctctcctgcctgttcctgtactcgtggcattgttaccagcgtgcaaggatttcgactcacatattcagctctaagagcgtaatcaaaaatcatcgaagcgtaattcagccattttttgtaggatttagcctccaaaaaccacttattaacaactttttggcagacgttcggagttatcttattaattatcatatctccgaaggcaggtagtacatggatattgataatccgttgggtcttctctaaggtagactctcgcactgttaaacggtactgttccatccactccgcgcaaacatccctgaaaaagcgtctctcatcctcctgtagtccccttttttcgatttccaattctaatctactcaatacgatggaggcctctttcctcgtcttaaagccacgtcttctcgtggtcttttggcgtccggttagagagtcaactcccacgtacacctgaaattcatatctaatttttcctgtttttgttgtgtatttttttatttttgccattttaattttcgctcctgtattgcttgcgaggcctacatttttgaaaatattgggatgacctcccgtgttgcagagtcagacccgcaacagctacatgttacattgaaatctttgtttaggcaactcaaaaaataaatttaaaaaattttacaatttttttgtgagatttctttttttatacatattatctgcagagacacagaaatgtatctgattggtgttttttttgcgtttttagtcgagaaaaaaattttaccctatgttatctatgtacgggattaaatagaaatgtatctgattgatattttttgtattttcttggcattttttcgtttttttatacatatatagacatggggatatttttttaatattttttacttgaaacaaaattttttcactatgttatctatataaggtaaattttattagatttttttagtaaaacactacatttttaccccatattataagtgtacggaattaaatggaattgtatctaattgatgtttttttatgtctttttggcatattctcgtttttttatccatattagtagtgtaaaggtattttttaatattttttacttgaaactcttttcacaccctatataaggcgcatcatacatagtcacgtaatagtggcttaaaaattaactggaggtttgcagatggaattaaaacaaataactgacaataaggaattaatggaacaactctctcttatgtttagcccagcacctcgatacatgaataaaaaggaggcatgcaagtacatgggaatatgttacagaactttccagaaggctattgccgaaggattgcccgccgtgcagattggaggtgttctacgctttgaccgtttagtcatcgatgaatacttgaagaataaaatcatttaattaataaaaagtacgcttgcgaggcttatttaagaataaaaattatttaactaagtataaaaaatttaaggagtaaatattatgagggacgcacttaagcgaataggaaaataaagaacgcggaatatgtgggagttgttagcagactgggttataagactggatacaacgggcatggcaagcctacctttttgataataaatttaacggatattaatggaaatctagtagctgatcatctgtggattaattacactaaacaatttcaaagtttgggtattttggctacaggtgatgaagttcaattcaatgctagggtgtctagttatctcaagggttatcaagggaatgactccaccataagaaaaaaacatcctattcaatatgactataaattagaatatccttctaaagttagattactaaccaaaaaaaagcctcaatcagtaccagaaaccaattgggaattcctccaatatatattagaggaaaataaagacttctatcttaaaagggctaaaaatagccaataaaatgaatattttattccaaatacaagcctataagtgctgttatatcaacatttgtaagggttatgttttaaaaaatacagaaaagggatgacattattgatgaatcagacaagagaatactttgacgctacagtagtaggatttgacatatttgaatcaattacaggagaaaggcgccctatcgtctatctgagaaatattgggagcgataaccacaattttaattttggatggattacttacacaaaagaaatatgtgaaaaattaggactattgcaaaaatgggattggattaagttcgaggctcgcattccaaataaaccacatttccccaatgctatgcctagcaagattgaattaaaaaatcctactaaggtattcctgcccaagctggataatcgtatcaaaccagtatccaaagctaaggttatgactatgattgataagtttattgctgaaaaagataaagctaaacgagataaggaattggcacaggagcgaaataagttaccatttagattttaattaatattagatatcgtatgggcgagtttcgcgtagcgataactcgaacagttattaacttgtggtttttgcaagttgataacctaactagtactgtaattcaatattattaattgttatgggttagtactagtagttgctgtcttttcacttttttccaaaaagtaaaaaggttttcaattttctacgaaaatatgaaaagtgactatattaatcaataataaataacacgttttaaaatagtcccccttctatatataaagcatagggactaaaaacaaatataaggattgaaataatggaaaataataaaatttctacatcgataacactcggagagccaggaagtggcaaaactacgaaattgattaaagaagcaatggaaatattagcaaaaggcgaaagtttatacattctaagtcccacccacaaatcaaagtcacagttgaataaagctatcaacaaagccgttgaaacaactggcgataacacctataaagagctattttccagcctccatgtattgggtaataactatgtaggtgaagccaatatattactagatgaaatcagtatgttatcacttgataacttctactctattctactaaaggcgaaacatcatgcgaaaaaaatgcttatgttcggtgatataggacaattaccgccagcacgaggcgttggaacgcttgaatatctattgcgctccaattctagacttcttaacatcgaccctcataatttctggaagggcatctcatcactttacgaacggagcaataatgcaggactgaacattccgagacagtggagagatgagatatactcaatcaaccttaatatattacaaaaaaactaccgtcttaattttgaaagtggattaacccattatgatgataatttctatgattatgtctttaagtcaatcattgagaaagatgaatatacacaggaattagttaacagccttaaagaaagcagattaattattgcgccctctcatagtctgattaacagcatagatgacctgctacagtcacattatggcaataattataatcaagtagcgccatttgttcgcgttggctccagaggtacaggaggaaagacgtatgttaatccagaacaccctcattatgcacaattactcaatagattctatagtattggagcaatgcccaacaatacaatggagaattacacacctaccagcgccgtaacctcgcactatattgaaggaattgaaaatgatggagtcaccttctatttgggaaaaagagaaatcaccaaatcaaataataatacacattttctaaacaacaatatgcttttcacagccgtctccagagcgaagaatccagataaggttgtactattgggaaaaagagaaacttttgaaaaaatgcgtcaaactatgcccatagaaattgatataacagccaataatattgttaatcaaaacgctaaaaaaaatactatgacgaaaattaaaaatagtagtaacattctatccgttgatgacatttataacctctttttggaggagtttgagaaagagaaagtacagggtaagtatgatgacttattggacctaaccccagaaaagcctcgttatataatgaaccaatttaatccgagatggaaaaattttgaaacactaccacagggatatggacaacactacgacaattggaaaaaggaacaactcaataagggtaactctaagggtggaaaaaataaaaaaggccgtggcaaagtacaacaatatgtggaagacctatttcacaataacctggaagagttcaacgccctcaaggaagaagcccttagcaaagtgtcaccaaacgattttcaaaatcatcgtggttataacaaatactctgttagggatgcaattactaagattgaagcaattaattaacaaatactcatccccttttaacacacaaatggggatgcattatacataaatcaacctaaaaagttgatgtggtaccttgtacgtacataaaaagttgcgtggcattaacagaatatttattattttttctaaatcaccccccaccctattaaatcagcatttcaagtcgtacaaatttcaaatcatcgtattttttatgttcttgtttccctcaatctcttcggacccaccttaccacattaatattcataataatatataattatccaatgcatgcataataaaaaagcctgattataatcaatcagagccaccacttttatatttttcgtttcatttttcatttgatttttgaagcttgaaaagtctcacactgtccaaactgtcacactcttataggcaaataacatcagcatagacaaccattaacatacgtatcacatcaccacctaacccaccatataggcacactagacaaccatacgagagcgtaaaatatcttgtgtaaatgcataaaagatttctgaattgtatagaaatagggaatgccttcccttatgatatttagtaaccacagaaaacatcacaggaggcattccccatgaatgaacttaccacagaaattatcgctgcactagcccaaaagcaagatttggacgaagtttttcgtcaccacctcgaaattgcgattaaccagctgcttcaaaccgaattggcagagtttttgggttacgaacgctactcatacgctgggattaacactggtaataaccgcaacggcagttatgagcgctcgtttgatacgaagtacggccaacttaacttaaccattcctcgagatcgcaatggccggtttgaaaatcataccttgccagcctacggtcggcacagtgataatttagaaacaacggtcattcagttgtataccaagggaattaccactgctgaaattgccgaactcattgagaaaatgtacggtgctcactactccaaagccacggtttccaacatgactaaagccgtcaatgaacaggttcaagctttccagcaacgtcgactggcttcacaatatgcggccatcttcttagatgccacttacttgccgttaaagcgggataccgttcaaaaagaagccgttcatcttgcgattggcattcgtccagatggtacgaaagaagtgctgaactaccaagtggcgccaacggaatcgactggaatctggactgaactgctgggaaccttgatcaagcagggcattaaagatgtgctgttgtttgtggcctatgggttagttggtttggatgaaggcttgaatcggcatttccctaaagccaaacgacaacgttgcctggttcatgttgggcggaatctgatgaacaaagttcgtaaaagaccgcaaggccgtgatcagtgactttaaacaagttcatcgggccgccaaccgtgaagcagccgaactgaaactgaatgagttcgccaacaactggcatcagacctatcccaaattaatcaaagatctgcttaaaatgccgaatttactcactttcatggactttccaccagctatccggcaatcactatactccactaacctgattgagaactttaataagcatctcaagcgcaccacccaccacaaagaacaatttccaacggaagattaactggatcgcttcctggtttctcagtttaatgtttataacgagaagtctctgaagtggatccaccgagggttcaaaggactccaggacaccttggaagcatcatttatttaagttagatacatattatatgtacgaaggcatttcatttacacaagattcttgacgctaccagtatagtccctagtctgataatatttgttgtatttttctgtatttagttattcgatgatatcgaggctaatatgtcagccttccaatcagcgtcgaaatcagtttcgattagtggtttatatgaagtatctacggcatcccaaataaccttttcgtttacacctttatcatgtaaccatttaatcaacgtatcaattgtcagaggatatatggttgcacgaacagagcgatgttggacagcggtttcctctaaatcggttgcagccacagaacgccaaatattttcggtgttcttatcaacagcgtcagtaatgaaatatgtttgaaccggaacagtgcgactagcagaaagattgacggtatgcctaagtactggttcccactccccacgtttaatggcattcttatccatcagtgttacttcaagaaataaagtacgatccttgtattctatggtaatgtcaccagaattttcatcttgcttcttcttttgtcctcctgcttgtgccacaggtaatccttctgaatccagcgtaaggttcattgactctcgcaaactatacttctcctctgaaatgtaataccaggcaaccgcaatttgaaagactggtccatctgattgaacccaatgacacattgatcgtcataaagttagatcgttttgctcgtaatactgttttgctcgtaatactagagaagcattgaacttaattgatgacttattgaaagaaaaaataatgattaaggttttaaatttaggaacgatagataataccccaattgggcgtatgattgtcagaactttgctatcggtcgcggagatggagcgtgatatgattatcgagcgtacgcaagccggtaaaatatttgcaaggcaacacaatcccaactataaggagggtatacccaaaagaaaaaaagatagccggaatatggctatctttgaatattctaactctcatactgtgaaggaagccgctgaagctattaaattattgaaaggaatcagccttttaaaaagtcaacaaagaaattctgctttaaatcatattagggtatcacaaatactttacaaatattttttgcgtcgcaaccaaaaccagcaaattaggcttagtataacagagataatcagcacagcaaaaaaaccataagaagatttttcaaacgggacatcgacattgattccccaaaaaccaaaaataatcgctggaatagtcaaaacgattgatatctctgttagagttttcataatcatgttaagctgataagaaatcatattgtttatcatatcttccaaatcatccaaatattggctgtaacctaaaataattctatccattgtgtcgcttatatcgtatatcccgtcaattattttttggtggtaaaatcaataccattaatagttgtaaaaatttttttaatgaaatccagcgctttgtgattagcgccataggttgttgacaaagctatcatgtatttttgaagagtcaataaatcaccaaacgttggtctgagtgaaccggacgttgatatttctgagtctaaatcatcaattttttccttgactccacgaaggtggttaagcatcacatggaaatctttttgtatgatctttaaaagtacttcctccatgaaattattgacaccacgtaaaaccatattggataagagttcgggaatgaattttaatttttgttttgtaaaaattatcaacttatttttaaataccaagaaaacaatagatgtcgtcagattatgtagatgcccaccttcatgtacctcgggaaacaaaaaacttacgagcaaacttttttcatcgttccgatctatcatcgtgtcatatgcaacttgatcatcaaacgttagtatattgcctatttcaaggtcatatttatgttcaaaagattcgatatattctcgttcgtcaccataaacataaacaatagaagaatttttgatatttgattctgacgaaactaataatgtatcttttgttaaagaataagttttcagcattgtaatcctcctgctttatatttttctcaaaaataaatgcgtaattgttgtgaaataaatacgttatcagttttaaaaacattttgtcttatgtatgataacctgccaaaaattttatctcacacattatctagacaatcttgtctccagcttctaatgtattatctaatttataattatagtccctaaacactgaatcaaaaaacttcaaatttcattagtaggatgttttcgtaatattaacactattttttcttttcttccatccactcttagagagtatacagaaatattaacggcagaatttaaaattagttcagcttcagcctcattgattttcaccctattagagctaccatgggaatcactattaatatttcgcatggtagttatagaatcaacgattttattaagaccactaattagagaagaaacatttttatcccacctattgtcaggtttcatgcccaatgttttattaactagagatctataatgaccaatatctccattttctttaaaatcgatctgatgcttacgtaatattactatgaatactgtttcaattattgttctagatttagttactacgctgtctaaatcattatttaataaatcttctttagcattgttgagaatttttttgacataaccaatattcatgatttcggcagggtcaacaagtactttggggggtgctttagaatcaataatggctattttatcattgagaacaattaattttttatcggacactgatagttctaagttgatcctattaattaaatctgtcctcaatatattagcaatcactttattattttgttctgtttcttctactatttcggtagattgcaaatttaaccatacgccaacggcgtaacgttgaccaacgatccaaatataatcaatctttggggcgatcaattgaacagcgtcccatgatgattaatcaacgtaatcgcatcgacgattttgaactagatacagtcgttggtcctcgtgggcatagtaagacagttttattaactttaatcgattgaaaatcacggttcctttgggcctaccggttaaaagatcggacgacagcgactgttaatgaagcactaactaagttcctaaccacttttaatggtccggtgcacagctttactgtggaccgtggcactgagtttagtgggctagtatcacttgaatcacaatatggtattaagacctattactgccatgcttatactccagctgaacgtggtagtaatgaacgctttaatcggaatttacgttatttttatcctaaagggactcgttttgagcacattagtgctcaagatttaacgacgacattactccaaattaaccagcgaccgcttaaaatactcgactggcaaacaccgtatcaggttatgctgacaaatttgtccaaaaattcggattaaatttgcaatctaccgacaaattttgaaaaaatagtcaggacacgtcctggagaggctgtgaccgttagagcacccgagtattgggacgacgaagcaattaaatggaacgattttgaacgacctaaaaagcaacgtcccaaccaatggcacgccattggtgagacgcggctatccgggcgactcataggtggtaatttgaacactatttatgggattttagcgtcgaagtattttccaaaattgactttcggagatttgttatttattgaagatgccgaaaaggatgcggcaactgttgaaaaaaactttgcgatgattcgcaatgctggcgcttttgataaggttcgcggcgttattcttggaaaacatgctttgtttgatgatcttggtactcagcgtcggccaattgatattttgctggaagtattaaataatcagcgactctctatcatttatgactatgattcttgtcatacaacgccgatgatgacaacacccttgggagaccaggctgtgattgatgcagagaaatgcaccgcttctttttcagacttttagatatagaatatatgtagcatacggttatttagactttgacacgtgcatatcagcaagaatacgtttgtaccggtggcatttaaagcatacgtactgaataggatgtccaatacaaacataaagatatcgtttagaagtcgacccgctttaatcaacaccgcatgatcacaactaaaaaatgatttataaaagtggtaggttgccggtcataataccattattaacgctgagtaccttgttcttattaaagactgtcaattcgtaattccccagaaaatatgattctagatactaataataaagaattttaaaaaatcaatctgagtatgtgaaaaagtaattataaatttaagggtctataactatcaaataacccctcaaaaacgttgttaaaatagcccccaatatctataatgcagatattgggggctattttaatttatttttttataagtgcccctaaactatagctattgattcaagatttcatgggagccagttgcaaccaataacaaaatcaattcatcatgatctagctgataaataacaatccagttgtcataatttttaccatagtttccatatctggcagggtgaaattcacgatagccacgccaatttccttttaatgcatgatctttaatctgtttcaaaacaagtacatcttgttcaacaattgcttctaaacaaggcttcaagacagttattgggaaatgttttttgactagtttttttaattcacgttcaaaagatttggtctgtttaatttgcatctaatttatcgatccaatcttcaaagtcagtcaatgaaccaatgtttttgacctgccctgtttctgcttcttttttagcggctaaggcttccggagaatctaaaaagctgactaatcgaacttcattattggccgctttaactaacgataagcgtatatactcagaaacggttagcccttgttttgctagattagctttagcccgttcactaatgtcaggtgttacacgagttgaaattgtcttgtttttaataatagtattactcattctaatccgcctcctttaagtttaccatcgtactacattataatattcgatttttaggttttctgcaactaaattaattttaaagtaaaggaactaacagcttatgcaacaagttgtcttacccatcaaagattcaaacgttcttaaagaggttcaagatacgttactcaataactttaaagctggccgacgtaactatacagtttttcaagttggtaaagctacgctactgcgagtgagtgatgtcatgcgcttaaaacaaaccgatatttttaatccggacggttctattaaacaaaatgcgtttattcatgaccgaaaaactggtaaacctaataccttgtaccttaagcctgttcaaacagaactcttattgtaccgtcaatggctgcttgatcataaactagaatctgaatggctctttccttccattcaacaccctgagcgccatattacggaaaaacagttctacaaaatcatgagcaaggttggcgatctgttaggaattaattatctagggacccatacgatgcgtaaaaccggggcttatcgcgtttatacgcaatccaattacaatattggcttagtcatgcacttattaaatcattcaagtgaagccatgactttagcttatttaggcttagaccaagcaagtaccgaaagtatgttagatcaaattgattttggttagttttctttgaatttttagttgttgccgaaggcaacttctgagacagattttaagcacaaaactcccactaaattttagtggggtataagtgccccctttggtatataaaaatgatagaaaaggagtggtactatgtttcaagctatagcttttgaaactgaaagactgaaattctgtgctgcaacaccaaatgatattaatataattagagataattacttatcggaaaagtatggttatcaagatcaaattatttattcgattttagatagtgaatggagaaagaaaaaataatttatttttacgaaaaaaaggcgtctataaaattttatagacgccttttttcgtaattttttaattactactcaattggaatagctttttttatttctttgttactatcttttggcaaggttagtttaagaattccctctgaataagaagcctttatttcgtcttctttaacattttctaataaatattgacgtcggacacttgttaaactacgttcgctacgaagcaaccttccttttttatcttcggttgctttatcaatttggtgttggccactaattgttaatactccgttttcgtaagtaacttgaatgttttctttaggaataccaggaagttcagcttctacaaaatattcattatcagtttcatgaatatctgttttgattaaatttggcttaaaatcattgaataaattacgactaaagtcttcaaaaaaattgaaaggtgtcatgttatatgtgtctgagttacgtttttgaatctcgtttgacataataatcagtcctttctatattttcttttcaattattattttagtcaaaaaagggcagttttcaagtattaagctatttgaaaattgtgaaattatttttcatgtgatgctatcagcatatttttttatcgctcgtaaatactcatgataggcttctagttcttcaagagataatttaaataaattaatttgattcatgtttgataattgatttagtaagtttgtttgtgggtttttagaatcacttttatcgaattcattatttaaaacaaagttcaacatttttgagtgaatcgctgattgaaattcattgattatctcaatttcaaatgtttttctgtaatctaatcccatgttgtttgttcctttctggtttcgctttgctcaactaaacatttacttttaattaaacagactttgctagtttaatcaaaagtaaacgtgcgaataaaaagcaaatcatttttaaagctcataaaatgcgttctaaggcgttttagcgtttatttcgttagttgtcggcataatcgttaaaacagcggttctcgtaacgtaaaagcccttgagcgtagcgtggctttgcagtgaagaggttcgctgttagattatgaaagccgataactgaatgaaataataagcgatagcccactatttcggtaggaagaggctcaagggagtttgagggaatgaaattccctcatggtcttatggtttaaaaaattgcttgcaattttgccgagcggtagcgctggaaaatttttggaaaaaatttggaatttgtaaaaaatggggggcgaggaagcgaattttgcttccgtactacgaccccccttttaagtgccgagtgccaaaattgaattttgtgggggcttaagcttactccctcaaggactacagcgattaaaaaaaatcaacaaatcgccaacaaaattggcaaaaaaacgtgtagacgtaaaatagtttgacaaaaaaagcaaataaaagtaaaatttgtttacaatatttaagaggagaatattatggctgaaaataaaaaaagagtttcgattgggttgacggataaacagtatgaattagttgaaaaattggctaaagaaaaaggcttttcgaagtctgcaatatttgttttagctttagaagaatattcaagaaaggaatcagagcaaaaaaataagtgaggactcattcccttcaagaaatacgagttctcactaatgcttgttctgtcaaggcgattataacaaatagcaaaagaaaagacgagatacttcacttttttactttatccagaatcgataccacaagattggcaaacaaaacttgaaactttaggcgttccaattgcaattagcccgcttcatgataaagatttgagcagtgttgaggggtaaaagtataaaaaagcccattatcacgttatttatatctctaaaaatcctgtcacagcagaaagctttcgcttgaaaatcaagcgtgctttaggcgataagagtgttgctaaagtacaaattgttgtccagagcatggaaaatatgtatttgtatctgacacatgaatctaaagacgctattgctaaaaataagcacaagtacagcaagcatgacattgctttactgaacaattttgacattgatcgctatattacgcttgatgttgaagataaagacgacatgctgaatgatgtttgcgatttgattgatgaccataatttggcgaatatgcgtgaactgagacgatttttaaaagctcatggttcagaatatggcatgcccggtattaaagtcgttaattcggttttacgtgctcatactggactgataaggccgtatttcgatgctgtttatcaggaacgcaagtatggcagaggcgatataaacaaagagactggcgagatacaagattaattagcgaatggaaaatgggtgctcaattgagcacccatttttattgtcggatagccgacttctgatacagggaatttagaacaaacaccagcaattttaattgtggtgtataagtgcgcattgacctcgtttcactcggtctgctgataaccataaaatcaatttctgctgttgttgaattgactgtatttttaattcaatttatgtttgcacctaactaagattgttatgttttaaatatttaaaaagtgttgcagattacgctgttttaagccaaaattttttaattgctttgtgcagagaatttttataagtttggtaacaaattttgaataacggtgttgtaagatctgtaaatctaaactgaaatcattattttgatgttaggagtcattaagatggacgaaaagaaagtattaaaaccaattgatgaaatgcttgctgatccttagcaagttgatattcaagaattgtttgaagcttttgccaatgaacctgacgagatcaaaaggaatctgtatgattccttatacacttatattttgcaaaaaagacaagaagatattattaatcgtcctagcttcgttatttagccctttaaaagtcttctgagggcttttaatttttgctttggtataaatgtatatgaatggtcttaaaatcgctagaaacgaattttttaaaagcctttctaatagcgaatcagctgtcgggtctggtttatctcgccacatatcgtaatagcggtagacagtgtgccattccgggaaatcgtgcggtaattcacgccattgacaccctgtagtaagcgagtaaaggatggcattgaatacgtcataaagatcataacgacgcggtcttgtatgcttgcggaagttttctaaatcaggttgtattaacgcaagttgcgctcgagaaatattgcttggataatctggcatgacaaactcctcagtcggttttccacaattctaccagattcagcagatactagacaggttctaagaggcatttcaccatactaacaagaaaaccaaaaattcccagatcattaatttaacatatcgtatcaaaccacgcctggaatattatctaggcgtttttttaatgtcatggtattttctggcagaaaggttgcattattgtgactacagttataaactaataagtgttaataggctacaaatgtaaacttagaattcaattaatggaggaagccaattgaaggatgcaaagaatgtaaccatcaccgattctgaatggatggttatgagagcaatttggacaatgggacatgcgactagtcgtgaactaatcgatgctatgaacgaattagaaggctggtcagcttcaacaaccaaaacgctacttcacaggttgattcaaaaacaggcggttgcgcagcatggcggcagtcgaccattcacgtataagccggttgttggcgagaaggaatcaatggcggcagcggcagatgatttgtttgaccatatgtgtgcgatgcgggctggttcaacaattgccggcgttattcagtcaagggaactctcacgggcggatattgcgaacttacaggcgattctagctgaaaaggccaaaacagcgcccgaggaagttcagtgtaactgcttgccaggtgatcaaacgtgttaagactgtggtgttctgtttacttttaggattgctgtacaaaaatccagaatctgggatttctgatggcagaaacttatgaatttttgtcgtaattctcattcatatagtggcatggtgctccgcaaagcggaagcctaaatataagaacctggtggaaaaatcccgagcccggggatttccacacaaggaacttatattccggcttctaaccgctttgctacgcacacttatttttagggggtcgataatcatggcaaataaagaggaccatatgaacatgaaaaacatgagtgctaagaatatggaaaataatgaatcaaatatgagtcatatggggaatttgaaagttaaattttgggtctccgctgtcttagcgattccagttttactgttagcaccaatcatgggtttaaacgtttccatccttagtttcagttcaccgctaattgttggcattatcatcgttttgtttgatacagcactttacttttatggaggaatgccatttttaaagggggctaaagcggaaattcagaataaatctcctgaaatgatgacgctagtaacccttggaatttccgtttcgtatttctacagtttgtacgcatttattgccaacaacttcttgaacccggcaaatcatgtaatggatttttcgttcgaacttgcaaccctgattttaattatgcttctaggacactggattgaaatgaatgcattgatgggggctggggctgccttacaaaagatggcggccctgttgcctaagacggcccatctagttacagataatggtgaaacaaaagaagtgccagtatctgatttaaaagttggtcaagttttccaagtgcgttcaggtgagagtattccagccgatggtgttattacggctggggagtcgaccgtgaatgaagcactggtaaccggtgaatctactgccgttaccaagaacgttggcgataaggtcattggtggtacaaccaacaataacgggacgctaacggttaaaattagtggtactggtgactccggctatctttctcaagtaatgaaaatggttcaaaatgcccagcaagctaaatctaaagcagaagataaagctaatttagttgccaagtatctattttacgcggcatttggtgttgggattattgctttctttgcctggttaccccagggattggcgactgcaatgaagatcatggtgaccgtattcgtgattgcttgcccgcatgcattaggattagcgattccattagtggtttctcgttctactacgattggcgctcaaaatgggctattagttcgaaatcgccaagccattgaagcaagtcaacatgttagccacgttctcttggataaaactggcacgttaacagaaggtaaatttacggtgaacgcattgattccaaatgatgggattgacgaaacaacgttattaagccgactggccgcccttgaaaataattcgactcatccgctggcccaagcaatcattactgaagcccaagcgaaggacattgaagtcgttgcggctgaaaagtctcaaaatattccgggcgttggtatttccggtaatgttgatggcactgactatacgattgttaatggtaactatttaacgaagcaagggatcaggtttgacgaggccgctgctgataaatgggctgataagggtaattccgtcagcttcctattgcagggcacccaagttcaaggaatggttgctgaaggcgacaccatcaaagcgggtgctaaggaattaattagtggtcttcagaggcgaggaattacccccgtaatgctcactggcgataatccaaaagccgcggaacacgttgctaacttactaggattgactgaattccatgcaggcctattaccagatgataagcaaaagattattgctgattatcaagcaaagggcaatcacgtcatcatggttggtgacggcgtaaatgacgcaccaagtcttgccgcggccgatattggaattgcaattggcgccggaaccgatgttgccattgattccgctgatgttgtgttggttaaatcagaacccagcgatattttacattttcttgatttggctaaaatcacaaatcggaaaatggttcaaaatctctggtggggagcaggctacaatattgtcgcaattccactcgctgccggtgtgttgtcatttattggaatcattctagacccagccgttggtgctgcggtcatggcgatgtcgacaattatcgtggcaattaatgcgatgggattgactggtgaaaagattaaaaacgtgtaattaagtgatgacaaaaagaggagaaagatcagctggtagtctggtctttctcctctttatgatcatcatgtcaattacttatctggttgctcagttaatttcgccaatttttgatgcagcctaatgtcatattgcctggtaattggcattaacaccgcgaccaccccgcaaatggcagcaccgattcctgcaatcacaaataggcgttcaatgccaatcacatcagctaggggatcggcaaaaattaagccaattggtccagctagattcaacaaagaattcaaaacgcctagaatccgccctaactcttctgctggataactttgttgaatcattgccattaaaagcgttgtaaaaaatggggtcgcaattccttcaatgatgtttaaagctgcgaaccataaaaatccggtttggttacctggcaaaatgccgctaataccggttggaatgccaaccaggaaaaacgcgatgattacgggcttcatccggtcctgccacttaccaaagaggccaatgatagtgccgccgattagcatgccagttgaataaatggcttcaattaagccagcctgactaacggttccctgaaagtatttcatggtcatgagtggatacatgctggcagcaggcatgtaggttagtgtgaagacggtgccgatcaacgtaatgtaccacaagcccttgttgttcgtccgccgatgtgcgtcctaacgtgccaacacgtgtgtacgccgatttcagtatattcaagcattaaaatgtggtgtcgcagccagctggagtgcaagttgagttgcacgttcgagcgaatcgtttgtttgttgttcccagcgggccgcgagtgtgttggccgggtcgtgcagactagttaagatatgttgggcgacttgcaacgcgtgtggttgatgtaaactggtagccatagtttgtagcgcgtcagctagttgttcgccttcagttagctgtcgagtcacttgcatgggggtttcgatggcaacttgttcgttggcgcgctgacctacctgaatccaattatccgtactagctggcactggtaaccagagcatcagtaaaacgaaccacgttaagcaggtcagttgggacagatcaacgcccgcaccggcccatgggttcaggtctaagttacgtaattccaagtattgaatcccatcctgacatagttgtgaatgaccaccggcatgacgcaatcgaacctgaccgtaaaattccttggtcgcacttaattttccattatcgacggccgcttgcagtgtttgaaaatagtcatttaacgacgcgtacgagaccgtaacacccggccgattggtatacccgctagaactgttgcgtaagcttcgaacgggctgggctggtggcgtaaggccagactgtggccagcagcgtggtgagcagccataaagatacgtcagtagccagcgatagtgcaaataattctgcgcaatgtgcaggtaacagcgattttgaaaggtagtgaaatcacgactatctgtctgggcctgatacaatcccatcatcagactagccgctaagcttacattacagtgaacacctgacaacatttgacgtcgtcggccatagcggtgagcaagtccttgtcgataggcgacagcggccgcatccaacttagcaattggaatatcccggtcttctcgtggaagtgtgggcggcatgcttagcggccaaatcagttcaggcagaagcctttgccggacttgttgtgtgagcatcgttaaggcgtgcaacgcagcaaccgcacttgcttgcggttgggtgactaactccaactgtgtctccgcaaagtcccgttgcaggccggacaactcgctgataagtgttggtgataatgccgtatccgccaaatgaccggtcaccgttacccgctggccttcccgttccagcccaatctgaacaacctgtgcattgatcaacgccgtattttccattaataattgttgccactccatccactcacctcgctgattcaatctaaatttatcgtagcatagtcccgaccttggttcactgattatgacctattatttagctgacttaccattacgaaatgagtttccgcgcgtccctgcttgatcatccaaaggatcaaaaaaacgagtacccagtattaccgggtactcgttttcagggtaataatatcgggtctagaatttttggtgttggaaagtatttccattccaaaagtactaggccctaatttaaaaagccattgataatggatcaaaaacggccactagggtataccctagtggctagattggtttagtcaaacaaaaatcgccggccattagctggtaaactaattgggtttaccaagactgatgaccggtgattacaattatcgtttttaaacggtgcgatgcatacttcgttcgatgactaataaaatgacgaaccaaacgactgaaccgatgactgcccaacggttaacttgatcaaagcacaagacgaccgtcaccgcgataaagaaggccaaggtcgcgatgttggaaacagggaacagtggcagtttaaacggattatgcgtactgtcagtggttcgtttgtaaacgtaatggcacaccaacaaggcacaccaaacaatgatgaagttggtcgttgccacgttagagatcaacgtgaagacggtacttggaatcacgtaattcaacgccacgatcaccagtaagatcaatgatgagaataacaatgagcgggcgggaacgttgtaacgattgacctttcccatccatttcggcgcgttgtcaccgtgcgcaagtgtaaatagtgttcgactcgtactgaagatggcactattacaagccgagagcgccgcggtcagaaccacgaagttgataatgctggccgcggctttgatcccaacgtcgctgaaaacttgcacaaagggtgactgactggtcgtgatctgatcccaaggataaattgccatgatcacgaataaagcgcccacgtagaagaatgagattcgaataggtaagctattgatggcccgtggtaattctttttctgggttttcggcttccccagctgtaattccaaccatttcgatgcccgtaaacgcaaagataacgagcgaaaacgacatcaagaagccctggacacctgttgggaagaagcctccgtgactgaccaaatttgtcaccgagaccgtttgcccaccgacatgggccgatgaaccaatcaagatagcccccgtcacgatcaaagcaatgatagccaccactttaatcatcgaaaaccaatattctagttcgccaaacgcactgacggagagcatattgaatactaataaaatcaaaataattattaagggtgtcacccactgcgggatccacggaaaccagtaacgaatgtagataccactcgcagtcaagtcagccatagctaaactgatccagcagagccaataggtccacccaatggcaaactcgaaacgtttacctaaatatcgattaatgaattctagaaacgaatgtaagcacgtatccgacaataatagctcgcccagtgctcgcatcatcaagtaacagaagaaaccgccaatggcataagccaacaagatcgacggccccgcctgtttgattgctgaaccggatcctaaaaagagcccggttccaatcgcgccaccaagcgcaatcatctgcacgtgacggcgttttagtttacgggcaagttgctgattttccatatgacctcaactttcctttaatccaatttgataataattttcataaaaatacagattttttcacgttcattcattttatgataaaacaatcggttctgttgcgaagtttgaaaatcaaacgcgccctctctgaactccaaatatcttaggctgttattcccattaataccttgatttcagtagacaccgaaaagccgaagagcgttccatttcttcggttctttttatatattcctcgaatggtctccatgcccttaatcgtggaagaggctgtacggagactttgataaaatttatttcgtcgtttaataggtcgatggtcttgttctattaaattgttaagatacttcacagttcggtgctctgtcttagtatataaacccacactctgtaactttctaaaggcggagccaagagaaggtgctttatcggtcacaattgctttcggctcaccaaactgtttatggagtcgttttaagaaagcataggctgcttgcgtatcccgtttctttcgtaaccagatatctaaggttaagccgtccgcatcaattgcacgataaagataatgccaacgtcccttaattttgatataggtttcgtccattttccatgaatagaaggattgtctatttttcttcttccaaagataatagaggactttgctgtactcttgcacccaacgataaatcgtagtatgacaaacatttattccacgatcatataacaattcctaaacttcacgatagcttagattgtaacgcaggtagtaaccaacagcgacaataatgacgtcttttttgaattgtttgcctttaaaatgattcattactctgtcctctctgccttttttctcaattttacactaaaatagattttttggaaaactttgcaacagaaccacctaatctattaactgaaagcgtgcttataatgcgtttctcaaacatcaaaacataaaaaagcacctatttctaggctttttcacgaaaatggttacggtgtaactatatatttttacatttttgaattcgcctactactttatctatgaagcgtaccaccacgacgtccatgtttatgatgttgacgtttctttttatctaactcgtattccaattcctcttgtgctttcctttgtttgttcagctcataatcttgggtatttgaataaagcacgctcgttaaggcatctgataataatgtactcatatactttattggagtattttcattataattaacggctctgtacccttctatattctcttttcggaaatcatcactccttgaattatgttgttttactgcctgcttagcctgttcaatttgcttagcagaaatatttttatcttgtcctgcttcaccaataaacaactgttgtgtgcctctattgttcaacacacgtaacaaattagcgtttttaatctcatctggtttaacctgtccgcttaaataagcaagtccttgtacatgctcttgcgttgtaaatttttctggtggattgttttttagacgagttatatcctgtttctccagtggttgaagctcaggattgtaataaataactgccgtatataatcgctctttttcagtcatttttaatttgtttaagtctatatcaggaaaagacttagttagaacgctgttgtattgtgtatcaaccacttttttaacttcattaattgctgaaagttctttaatgcttcgctttaatacgttttgttcattttcttcaaaaccgtttagtaaagcaccttttgttagcttaatatctttaaagcggtagccttttttagccaaaatatcgctagtattttccctgactcgctgttcttgcttttcaagcattaaccaactaacgaatggacgcttagtaaatgttagaatttgttgatttataatattagttcttatcattgccaagcggtcttttaattcgtttcctgcaaataccttttgttcactatctgtttctttaattagttcacgtttttctgccattgttacccgttcaaaatcaatatcagggtaaagttttctaactgttcgattaactactttatctagcaactgattagcttctgctaatgaattttcttgttgattaatagttattagttgctttgtcatatcctgtccaattgcttgcttaatcatagtgctatttttccaattaaatagcatacgttgtttttcgtctaaattttctaggctaacaaatgtttttaattctttacttagttgagaaaccatacgtttctcatcaaacgaataatgacgttgtagggtttgtatacgacgttcattatgaattttatcattcacattttttacttctgattttgcttgacgttgtagcttaacactacggttaaattcttggcgattttctctctgtgaattaaccccttcatgttgcgttgcaacttcatctattccctgttcttcatatgacttttcactaatacggtctagtaaatttttagactctaaaactttattaacagcggtagcccaattgtgacgccattcagttattttttcttttttatcccaatcaactaaccaaattttcttctgtcttggaaagccacttttagtaaatgttttatttccattttcatctaaaatatattgtgtttttgcctttaatccccatgttccgtcaggattaaacgggcggtttgttagcataacatgcgcatgcggattatctgtattatctctgtgaatagcaacatctgctaccatgcctgcattaacaaaattttcttgtacatacgctgtcaataattctttttgttcttccgttgataattcgataggtaaagcaacattaaattcttttgcgtaacgtgaatttgctttacggtctttgtcttcaacttcattccataatttttgcctatcttttgcccaatcaggggcatttttcggggttaaaataaatacttctggtttaatatctcgtggataataataagttttcccctctttatcagaaaacaacttttcgccacttcgataactcgcactagcaatcgcacttcgtccttttccagcactaatattactaaaactcatatgaaatattgccatgttagtcgcctctttactttggttctatgggttttcttctgttgtcgtcatcggcgacttctaatacaggattttgggggttatcacaacatagaattcattctatgtgtaagtgcacattgacctcgtttcactcagcctgctgattctcctgaatttacttttagtgtatgccttccgcttcgctatttcaacttttatcctttgacttaacgtttcctatatgatatagttccggtgattatttctaatatgattggagggatcgttatgtctcaaagtaacttagaaaaacaagaagctaaattaaaagcccttaatcaaaaaattaaggacgaaaaaaataagattgaacaacggctaggtaaacaaatcatcagtcaagccaatttagtttatgctaatttgtctaacgatcagattaagcttttagccaagcaattttctgaatttttaaaggtaaagtccgtagatcattagccatacgagatggggaaattccatgtctaatcaatatgaaaaactagtcgagcagcaagcgcgtttaaaacaaaaaattgagcgggaagattttaaattacggcaatctaaatactatgaaaatcggcaagcccgcaaagcccgttctcgccgattaattcaaaaaggggctttattagaaaagtactttcaagctaataacctctcggtcgaacaaaccgaagaacttttaaaaacatttgctgactatgttaacgcccataaaccggataaattaaaaaacgatcaacctaataactaggccgatcgtttttattttcaggattgttttttggcttaatttctggattgtgtttagaagttgtccaagatctatgatttttgatatacttctatgtaaaaagcgagtttaagctatgaaaaattatcccagcaatattactcggcaacaatttgaattaattcgaccagctttagaaaattttcgtaagcgaactaagcctcgaaaatatgacctctacgaagtcttctgtgcggtcctatatgtcttgaaaaccggttgccaatggcgtcaagtccccggtgatttcccagaatggcggtcagtttacaactattacaaaatttggtcaactaaagctgagcctacggctgattctttattggaacaagttttaaaaagattgtcattgctcggcgaacttaccaagggcgttcagctttaacttcctttattatcgttgacgctcagagcgtcaaaaacaccgctactgctgaaaacaaaggttacgacgctggtaagaaaatctcggggattaagcaccatctggcagttgatatcaatggctttccgcaggccattcacatgacgcgagcgaacgtctctgatcgagacggggccagtgcaatgatcgctttacatgccatgcatttacgccaggttcaaaatgtcttagttgatggtggttattcaggcgttaattttcagctcgatgtagccagtaatttaaacgcaaccgtgcaggttgctaagcgcaatgagttgcatcgattcgaagtcatgccccaacgttgggtagtcgaacgatcttttagttggctagagaattgtcggcgactttggaaaaattgtgagcgtcaattaaccaccagtctgcaaatggtcgttttagcgtttttagcactattacttaagagattttagacagcttctaacacttttagtatagaagggtaatgtttttgcttggtattgattgggtaaagaaatggtaaaaaataagagcgcgacaagacccgggttgaccccagagcataagacaaaaaatccagtaacgaacaaaaaccgttcgctactggattttttgtcttatgtggccggggtcaggatcgtcggagcgtatttcagaagccgaagggtgctcaaaatagcataactgctcaactatacacattccaaaaaagtcccccacccagcagcaagtcactcacccatcacatcttccgccagaccttcagcataatcagcatcgccacaatcaaggcgacagaaatccccaaagccagcatccaagcatattgcatcccggctaacgggagtttcacgttcatcccatagaatccggtaatgatcgttggcacagccagggtcagtgaccaaattgtcaaaaatttcattgtatcgttcaggttgttattagcaaggttgttgaaggtatgatcgattcggtcaacgacttgggtttcaatctcaaacatccgttggacctgttctccttcaatttgcacgccttcgaataaatcaattttatcttggtcagcaccgacaccaaaatgggtctttggcaaacgatcgagttcactgagattggtttggaccgcgctggacaaaaaggtcaacgtctgttgaagatatgaaagtgaaaccaagtcactgttcttcgtcttccggttcaacattttatccaaatagttgcgtttcttggtaatggcgcgagaaattgggataaagctgacaacaactgtaaacagtgtttccagaataaatgcatcgacgctcttaacctcgggattatccaatgccgagtaaagtgccgtgttgacttcaggtatgtcgctttgattaaacgtgaataaaacgcccttatggagcaacatgccaaatggctgggtaatgtatctcagcgcatctttgtcgagggcatacggcgccagaaagatgaataattggtcgtcctcattgatatcataaacataattagtactttcatcattatcagtgacgtactcaataatatcttcattgatgccatactgatcttcgagggttgcccgttcttcggcattgatttgaatcgtttcaatccatttggttccattgattgtcttttcgggtttgatcatttagtaatcctcctgttagttattaacctctattttagactaaaagaaaagggtctgtactagaatttcggacagaaacataagagaattgatttatccaaaaggagtcctcaaaatgacctattcacgcaatcgctacgaccaagattttaagaaaaatgcggtacgtttgagttttaactcttccaaaccagttaaaatcattgcctccgaacttggtgttcctgaaagtgtcctgtatcgttggcggaagcaatataccgaagatggaaagcaaacgccgtttgcttctttagaagctgagaaccgtgccttaaaacgtgaaaatgccgaattagcattggagcgtgatatgttaaaaaaagccgccgcctactttgccagtctccagaagtaacccccagcgataagtatgcttttatgttgagggaaacctctgtttctgtggtaaggtgggcgcgttttttagacgtatcaacgagtggttattatgcttggcggagagctttgccaaagcgaaacgccaaagaaaagcaatatcgtcaatgaatcaaacacttttttgatcaaggacagggcacttacgggcccaaacgcatctgcggtttattgcgtaaaaatggtaataaagcttcctatcaccgagttgcccgtctgatggctgatgccggtctgtattcaacgctacgttgtcgtcatccgaagattttgaccgatagccgccttgcttgtcaaggtgattatcccaatctagtgaaacaccaatcttttaagccgtttgaagccttatcaagtgacattacacagacgacaacatcagaaggaaaagcttacatttgccaaataagggatttgaccagcaacctagtgttagctcatcaaatatccaatcatatggacacggatttagtcttagcgacacttaaacaagcccaccaaaggtgggctttgccagaaacgtgtatttttcatagtgaccgtggtagccaatacacggccaaagcagtgacaaagttggtcaaccaatatcattggcaacgtagcttctcagcattgggaaaaccgggtgataacgcttggagcgaaagcttctttgccatcatgaagaaagagctcatttatcagatacaatttaaagatatcaatgatctgagagcgcaagtcttcgcttacatcgagaccttttacaaccgcgtaagggtacaagcacgcttagactatcttgcaccagtagcatggctttccttgtatgaccaagcttcacaaaaagtcgcttagcaaactgtccgaaaaagtgttgacttcccatatgtaagaatatcggcaagctcaagcttcatgttatcaactgacttatctgaaaaatcttttttactctcaacatcccacaaaaacaattcattcaattcaccggcttcaactgcgactgctcgggccaatgcaggtaacgtatgatatttattccaaccccgactatcacgaaaatcaattagctcacttattaactgctcatattccataaaatattcagtccttatcatccgcaaattctgaatcttaattagatacattggttttaaggtaataatatcacaccgcaccggtgttagttagcaaatcaaaaactattatttagaatataattcggacttgttttcttgcttctattgctcgttcaatccgcccctcatcataaagccgcaatacaaaatacatccccacataaataaccaacggaatccaaacataattcaaatcaatcatggtgagagttgcggcattctgggttcgattggcaacgtaacccgaaaagtgaaacaaaccagctgtaatcaagccgccaacaccaaggccgacgttaacgccaaagtcatccgttgaagccagaattccctcggcttggatccccatgctggcaccataacggattgtgtcagcaatcatgattgagacgaggccgataatgatcccattgccaatcgagttaatcaagacaccgccaaacaagaaccacagtattttggtataaaccccaaccgcaatcacggcttgaccaaccagcgccattaaaataccgcgaagcatcgtttgcttcttactgcgaacctcggtaattcgaatgatcagcaataccccgattaacgctgccagggtaaaactgttagctagtggtaccaggttttcgtttcccaccgtatatttaaaatagtaaatggttgtctgattcttaattgccgtcaccagccagtacatgagaatcacgattgacataacgatccatggctgattatgtttcaacatttttaggacagttgttaacggttgatgggcaatttcaggattcgcgaaccgttcgcgaacatggataaacgtgttgataatcaaaagaaatgaaatcaggctaaacacgatgattgtgcccaagaaccctttttgctgattaccgtggccgaagaacgcaaccaagggtaatgtgaataccgccaccacaatttgaaccgaactgccaaagaattgacgaatgacacccaacaacgtcaactcacgagtattctgcgacatcgttggtaagattgacgtgattggcagattaacagccgtatacagaaatccaaggcctaaatacgtcacatatgcccagattaatttaccattatacgaaaagttaggcgtcacaaaggtgagaaccgcaaaaataacgtaaggtaacgaataccagaggaagaacggtcggctcttgccaaactgtgaatgtgtgtgatcaatcatgatcccgatgacaaaactttcaacaacgtcagctacccgcgccacgacaaataaaatggccaccgcgcttggtgtcagtccataaacatccgtgtaaaagaatagcaaataggtcgtcatcatttgaaagactaaattatcggcggcgtcacttaagccgtaactaattcgttcgggccaccgtgttacccatttcgtcgtgcttttcatcccatcatcgcctttatcgaaattgttaatcaactttatcgtactctaaaattagttctcatgatatagattgtacacaatttggatgtaagctgattcctgagacaacttttaagagagggtataataaataaatcggctctcaaaaggaaggaatttttacatgccaactcgttacgacaaagaattcaaacaaaacattatcaaactatataagcaaggcgaatcagctgcccaactggccagagaatatggcattggctattcaaccgttcataatagggaggcttagatgccttttttgtactgaattgatgatagtggctgtcatgaggactgatcaatatgtggttgcgggaaagtgttggttcaatttaacgataccggcacctgcgttataatggagtcaacttatggtcatgaaatgtgataggctattgtaaatggtcatagattgtttaccgcagcgtacgataggaggagtgttcattatgcaattaaaattagaacggatttacatgaaaccagttgatacggatggttatcgggtgttggtagatcgcttgtggccccggggtatttcgaaggttaacgctcagttggacaattgggtaaaggaaattggtccgtcgaccacgttacgtaagtggttcaatcatgaaccagcgaaatatcccgaatttgtcgatcgttaccgggctgaattggatgagaatcccctgacggccagctttattagtcaagttgctgaacaactgacgaagacgaatgtgatcttattgttcggtgccaaggatgaacaacataatcaggcagtggtactgcgtgattacctgaaggatagtgggcaattaccaatcacttaatataaattgcgtaatattggtatagatgaaattgggattaggcctgcaataaactgcgcccatcgaattattttaattattttttgaaaacgctagcaattagctgcgaattttgctatgattatgttgttaattaatgacgtcaactattacaggacgcaataatggggctgcattgttaggcaagcaagattggggataattttatgataaacttatgtgtgttaccaagtaccgcaagttgtcgcaaggcccaccggtggttaatcgaacatcggatcccgtttcatgaacgtaatatgaatgcatagccgttaacggagacttaaatcaagcacctgctacagtacacgtacaatggcattgatgatttgatcagtactaagtccaatgcttatcaccaactgagtaagacgacaccgattgaagatatgccattaagcgaagctgttcgggtattaagccaaacaccgcaattattgcggcggccaattatttttgacgatcaccgacttctgtgcggctttaaccaagatgagattcggatgtttattccacgtgaacagcgcgtactcaagatgcaagcaatgtcagaactggattgtttttaacaaagtcatttagttgtttctgtatagctgcttcaaaggtaattttggaatttatccaaggaaaatcacgcaaattatttttaattacctggtcatgctctcttctgtaaactgatacaaatttttggctattatcgcagatcacgacgttatcagctttgaatgcaactgctgctaaattatgatttgattgattatagcgttttttaacaacttcatctggtaccccgtgcccaccctttttgacccgttcatgaacccgattaattgctacttttttgtttttaacgccacgtataaaagcgtgacctcaaacccattttggtgagcccgctcgattaaatttaattgtgcctttccttgaccagctaaggttgtttcaacatgaatactctgcccagtatttaaagccgcgatgatgtatctctttggctcactcatgttaaatcacaaaatgcttttcgttgataatttgctcttggcgtttatctaagaggtaagtgtgtaacgcgtcaaacagcttgcgtttatcaggatctggattatatgccgcttgttcccaaatgtcttgaatattgactacccaggggtcagccaacaattgctctattttttcgacttctttgcttggtttgatcatttaaaaggctcccgtcactttcacttagttcagtcatcacctgttcaaccacttaaggcgcctatttttgcttctaagcgattttaaagcagttttaataaattatgcaataaaacacttaaagcggcttaaatgagctaatatgacgttcaattccaagaacgctcattgttagtgttctgttcttcggggtgtttagccgcatattttctaaccgcttttttattccaccaaatcccaaataggttttgcatggtgccgtataagtagttctccacgttcttgatatgcttctcattgcttcttaggtcgttaaagtagcgtctcaaagctttagtcatcaaaggttttagttcttcgtcgtcaagcgggattagaaccccaatatcttgatgatccttttcaactcggcacttagcatttaagataatgccaataaaacgatgcatttgttgtggagtgcgacaccaaaagctaagtagttgcacggcttcgggttctaaaaaaaccggtaagccactctcttcatcagttaagaagtcattagcatgctttgtgaaatcatggttttgcttttgaatttctgctggtgagaaattggctgtggaaaagtccaacttttgagtatctatattatatctattagtatctatattattagtatagtctagatcttgtctctttttgagaagtccgcttgtaccaaggggtttaggcgattttattggctctcgcttaatataaacgtcttttgctgttacttccaaatctgccaaatataatctatttggttcgtttttgcctgatcttggattaaaacccatatgtttttgatacaaaaggtttgcgtccattaattcgtgtttaatcttattgattttattatttgaccagtttcgtaaaatctttggtagcgtcaagaatcttgtgtaaatgcataaaagatttctgaattgtatagaaatagggaatgccttccctaatgatatttagtaaccacagaaaacatcacaggaagcattccccatgaatgaacttaccacagaaattatcgctgcactagcccaaaagcaagatttggacgaagtttttcgccaccacctcgaaattgcgattaaccagctacttcaaaccgaattggcagagtttttgggttacgaacgctactcatacgctgggattaacgctggtaataaccgcaacggcagttatgagcgctcgtttgatacgaagtacggccaacttaacttaaccattcctcgagatcgcaatggccggtttgaaaaacataccttgccagcctacggtcggcacagtgataatttagaaacaacggtcattcagttgtataccaagggaattaccactgctgaaattaccgaactcattgagaaaatgtacggtgctcactactccaaagccacggtttccaacatgactaaagccgtcaatgaacaggttcaagctttccagcaacgtcgactggcttcacaatatgcggccatcttcttagatgccacttacttgccgttaaagcgggataccgttcaaaaagaagccgttcacattgcgattggcattcgtccagatggtacgaaagaagtgctgaactaccaagtggcgccaacagaatcgactggaatctggactgaactgctgggaaccttgatcaagcagggcgttaaagatgtgctgctgtttgtggccgatgggttagttggtttggatgaaggcttgaatcggcatttccctaaagctaaacgacaacgttgcttggttcatgttgggcggaatctggtgaacaaagttcgcgtaaaagaccgcaaggccgtgatcagtgaccttaaacaagttcatcgggccgccaaccgtgaagcagccgaactgaaactgaatgagttcgccaacaactggcatcagacccatcccaaattaatcaaagatctgcttaaaatgccgaatttactcactttcatggactttccaccagctatccggcaatcactatactctactaacctgactgagaactttaataaacatctcaagcgcaccacccaccacaaagaacaatttccaacggaagattcactggatcgcttcctggtttctcagtttaacgtttataacgagaagtctctgaagcggatccaccgagggctcaaaggactccaggacaccttggaagcatcatttatttaagttagatacatattatatgtacgaaggcatttcatttacacaagattcttgacgctacccagcttacgatttggccctaaaatacggtgttcaagtgatcgatcgacaagaactatttaatttcatcaacaacctctgtccagagctcctccccaaactccaatatcaacaatccatagctaaattacctgaaatatgtccaacctgtcagcagcccgctatacatctcaagggacctcatggtatgtactacaagtgtgtaaagtgcaaacatacatgcaaccctaaaccctaaaaagtaaaaacaagaagatcaataagtttaaactaacttaatggtctttttttttacaagattgtatacctaataagaccatactgaggttcaagaactaggtatatatgaaatatataaaaaatctaatggcaattgagagcacaaattattcaataaatctccatctcccaatatcttcgtcatagccctctactagcggattaaataccgataattcctctataaacttcgttgtttctaaccataagtgttgctttaggtaactaatccactgatcctttaactgctgattcttagcaaaaagagcctttaatgccattgacaatgttgctaatttagaaggcttattacctctaccttttttgatcacaagcttattagatttgacagcttgcttaagtactcgattcaaactcgctgctgaaatatttaattcctctctaattctgcgggtggaaatttcaacactatctttatcaattccaatacgattaattaagtcaataatgtcctggagccattcattcttatgactgtagatgcgttctgatcggctcttcgcatacttgtaccacttaacctggctttcttgctttacaatgcgtttctcagcataagtcgcccacgtatcaataagttcatcaatgtaaatcttggcggcacctttataattacccgaaaaggcgtcccgaacacatctttgcatgtctcgaagcttcaaaggtgcttctaaggacgaattaaattcatctagtaaatcaaaagtctcagcttctgttttacctgaagaataacatgctaatgctaaagtaagaattgtattatgtcttccaaggccttggcctggcataatttttcgcttacctagcataattttgaaccaggcttgatcacattgcttacgataaactccctggctcccctggttagatacaacctttaattttaattttctatcagcatttacttgtttactatattcttgactccaggttaaaagaatagcaaatgaactagttaaatctggttcaaagaacataatattgtcttcacgcggtatcctgaaaataccaaaattattacagccaacatctgttgctattaatttatcctggatatttctttttatattttcagcaatttttctagcagctgttaatacaggaattgtcccatttttatgtttcgctaaaaaagcaggcttatctagtatgtaatacacttgataccctttatccgtttttaaaatcagggtcggtaaaatacgatcccccaaaacaatgctactttttaaattttctaagttatgatcacgttccactgcatttttaaaatcaatatcaactacaaacgtattgatttgattcaaattagtttctatatgtcctttaatatgtttgcgcttttcatcgtaaccaagataactataaatatttggtgtccaatgagttaattgatttccattctctcgtaatgcttctttagaagtaatcacaaagccacaagcattactcatagcatctttgcttcgaaaaacagcaatcgatccggttttatctttattatgtaatgtagtattgattgataatactctactatttcttggcttaaattcttttaatcccgaatgtaaaactaaattaattgctgaccaagcggtcgacgaactatttagaatcctaggcatctacttaatcccctctcctcagactcatcattagcttacctaaaaacgaccaagcccgatgaaacctgctatttaaatcttggtaattaaaaagagttaatcaggtaatgctgatcaactcataaaagtgagtaagctagcataaaaaccaatattgccgtcaactcacaaaactttttaattacttacaatatttaaacattgagtttgaaaggaaattatcctataatacttatattgaagtttaagaatataaaccgttttggttttgtgagtcgttgtgaatgccagttcacgacggcttttttatttatttgttatgttaagtaaaacataacccgatataaatgtaaataaacattttcgattgtatacatatgaaattgttagtttacaaagtttacaatgtaaactttgtaaactttgtagactttgcaaactaggtatacaattgcgaacttttaaaaatacctattatatcaacatcctatagtcatttttgataaacatagcatatgtaaactgtgtaaacttagtatacattgtttacacaaaatttaaggtggtcgattttgtatacatttgcaatgtttatagtatgtgtactataatgaacttataaaataaatatgaggtgtttttatggtaagagaagataaagaaaaaacggattgtactgtaaatgtggtaggaaatttcaaaggtggagtaggaaaaacaaaaacattaactatgcttgcttatacgtcagccgtttataagcatcgtaagacattagtcattgatcttgatccccaagcaaatgcttccagtattttagcaaaaacaggaggcattaaaattattgataagaatatttataaaggttttgtcaatggagaactagcgtctcaaattactccgattatggaaaatttggacttattatcaagtgtaactcaatttaaaaatctacctaaattgctaatgtcaaaatttccaaatgatgatacagcacaaatcaattaccttaacgaattacttaagcctctaaaagagaaatacgatactatctatattgatgttccacctacaatttcagatttttctgataatgctatgatggcagctgattattgtattattgtattgcaaactcaagaattatctttagatggcgctcaaacgtatatagattacatgcaatacctaatcaatacttacgacaagcagcttcaagtattaggaatagttccatgtatgcttcgacctggtggccgtgttgatgacaaagtgctaagtgatgctagaaatgcttatggcaataacgttttggatactatagttaaataccaggaacgcttaaaagtctatgatgttgaaggaatccaccttaaaaagaatatcaataacactcctgatcaatgggatcttaaagcacatactgtctttaagaatgttttgaatgaattagatcaacatcaacttgaacttgaaacaaatttataaggtgggggaattaacatggctattgatccaattttaacttccaataaaaaaagcactttagatgataaaaaagtaaagttttcaaacggtaacgacttttcaaatcctgactttaatatctctgacacagataatactgcaaataaagaatctaacaaagataagacacataaaaagaagcgtacacaaactcaacgtctttctgaaacaacggttctcaaatgtaggacattacaaccatttatgacagaattagagcgagcagataaagcgtctattgatgatattatttcaacacttgcagactactatattaatcaaggtttacccgaccgacaaaaagacgtttttgaaggaatgtacgatataaacataaaaagattaaaataacttctataaactttgcaactgcaaaccatgtaaacttggtttactaagtttacatggtttgctaagtactcatttctgtacagatacagtaatttttcttaccaataaaaataaaatcctataaatcaatttcatttgtttactatgtatacgaagtatacatagtaaacaaggtatacatatgcaaagtatgtacaagggtttaaaaaagcaagctatattacatcgcctgcttttttattttttcactcacttgcaatgtctaacaacgtatcaactgtattttcactttgttgtcgttgtttcacttctttattaatagctaccaacgctttatattcctcttcattaaaaggctcttcgtaatcaccttgttcttctttttgattaggaaaaactaaatctagcatttggtctacttcattcttatcattgaatttatcatcaacataattatatgatacttgagcgaggtcaagcttttcatgaggggtatcgactttaatatcgttaattatagcattcccatcaaaagtttgatttaagatttgccatcttgctggcatactagttcttccagtatcaaaaattgggttagctcttataatttgtcccttctgattcgttcttaccgttgaacgaattacaaccatttctccaacttttagtcttagtaattcttctggttgaataaccttaacaccttcgaaagtgttactcatattatctcttgcaacactaattcctggggtcattgaatgggtgactacattgactgtagtatttcctacatcgtcactaatctctttcgcagtttctaaatcttttgaaagtatatataaagtattaccacaattactaataattgtttcagcttcttcttttgaataattgattctaagttggcctttattttgtaggacaaaatcaaacaataattcagatcctaagccaatcgaaaatttagtagccaaatcctggatcttaggtaaattaccaccttcatcaataatataatgtactcttgtataacactttctaccactagctgttcctagtgccatgttgtacatttgattaaagctttgatccactgcaaatgatactaattgattataagatggattatgagagggtgtgacaaagaatactgctaccggttgctcagaatatttaaaattaattatctgattaaattcttcgtcgaaaattgttgaattaagactgtctaaaatgactttaccagctatcctattaaagcgagttctactttttgccacatacttcttaagcagctttcccttataaatatatttatacttctttaagctttctgtagttaactcgtgattgaagtcaatttctaaattatacctatcagttaatttactttttaatgggtaattcaaataaccttgccgatcaattttctgagcccttttttcaataacattattattatcatctttccaagtaaccacacaggtttgaagagccacttgttttggaaattggatttcgattctacgtggaaatgcagcgtctctaaaatctaatgagttcattgatgttaactgtgcaactttcctttcctgatatatcttaattccggccatcatacttgcgtagatagaaccttgtgtttcactccctgtgaatctagattgttgaaaagcttgtaatgccatttctctaaactctgactttggtgcttgggccatcagatcgaaataataggataacttagaaatggtttttccttttacattaggatctggcatttcctgccctcccatctcagtaagttgtttgtaaatattgtacatagtaacttttttccaactctggtggcgttctgctaaatctaattgactatatatcattgcattaagtaagttaatggaagaattggaccagaatggatctttttcgttatcattactatatattgctgtagacaatcgattagcttcttgctgtgcttcgtcatagtacccttttctagcataatcaatgataatttgtagaggattatatgacattgacttagtagtattttgtagattcaatacatatactttgtagcctcttttttgtaatattttcgctgaaagttggaacatctctcctttaggatcattcacaaacattgaacattttttagccgctcttgataatatatcaattaaaggaagcatgatagtttcgccttttcctgatctagtaattccataaatcatattgttaactgtagtttgatcaattccataggtaccacctggtaaatgattaccaagattaactagcttcctctttaatcttttaaatagtaaactataactactactttggattaattttcccaatgaattattgtaatgacctaacggaataccgccatatccaggaaaatctttaatacggtctggaatcagttgatattccttttttaattgctttggatctgtaaaatattcctcctttttcgtttccattataagtttgatatgagctccaaaccctccaccacatataaataactgatatactcccaataattattgcataaggaaaaatcgggttatgccactcatttttcggtaaaagataatgccaatcaaacacatggttccatgttaaccctagttgttttgggtctgtccatacctgtccatatttcattaaattaactaaccattgttttcccgccttaaaaaggacataaatcattcccgatacatagaaaaaagccaacattactacaattaatatcatacctaagaaaaagttaactgattttatattccttgcccaccatggcgcataattttgtcttctttggttaattcctgatccaatattcttaactgccaaaagaatacctcctttttttataatttagctattgctcaatataaggaggaaaaactgctaatatgatgcttgagaggcgtattctaagagcgtttcattctatgttgatgtatacttgttttttgcttttgacgctccgcattgttcaacatatcaacctttaacagaatggattcaaggatttaagccgatttggcacctaaatcagctcaaagtttttctggactacgtcctcaaaaactttgagtgcaagtagaaacgccttggccattactggctgaggcgttataaaagttgcttaattaacttcaacatgtttccatgttcacgttcaaaaggcaaaaaagtttgtgagacacgcaatgctgtacctcataagcaaaaaaaacaaaggagaaaataacgtataatttataaaataagtattatatgttataattaatccatggaagatattgaatttgaatcatacaaaaggaacaatggtcatgatgagttcttagaatttatcgaacaactgcctattaaagaccaacagaagcttttagaagtaattgaattaacacaagaaaagggtttgttaatcgcacaaaaaatgaaatggattaaaaagttagatgataatttatttgagctgcgtagtaaagttagttctaatattcaaagagttttgtatttccatgtagttaatgggcgttacgtaattactcacggttttacaaaaaagacacaaacaacaccgcaaagagaaatcaaacatgctaaacaaattagggaggaatggttcaatgaaaattaacgacttaatcaaagaaaaaagtaaagaccctaaatttaaaaagggactcgatatagaacgtggcaaactggaagctgctatcgctttgtataatgcgcgaaccgatgccggtttaactcaggttgaactatctcaacttgcaggcacttctcaaaaaacaatcgcaaatattgaacacggtgaaaacgtcacttttgataagtttttttcaattatgaatgctttaggtagaaagattgaaattaaagtcatatagtatctcgttaaaaagccccagaaagagtaaacttcctggggctttcgcttataatcaaggttttttataaactattctgataacaacttattgtctgccagtgaataataactatccagtgaaataatataaagttcaacccgttctatatctaatgttggtattgcgatattatgaaactaagtaactaaattttaaaaagaaagaagatcaatatgggattattagttcagaaagctagtttttatgctatatcactaggaaaacgtcagctaatagctaagagatatcatagaattactaaagcaataaatagggaattttgggattctgaaagtgactctgctcatagcttatatgtaggctcttatggaagaggaactgcaataaacacaagtgatatagatattttagtcgaattaccaatgtcagaactagataggtttaaattttactcatcaaatggaccatctagattattacaagtcatacgaaaaacaattataaatgtgttaccaaatagcgatattagaactgacggacaaattgttaaagtaaatttttgtgatggaatcaagtttgaaatagtacctgcatttaaagaaaaagattatttgggaacctcaacaggattcatctacccagattcaaatatgggaggaaactagaaagctacaaatcctaaagaagaacaagtaactatgggacttaaaaatattcaaagtaacaatttattatatgcgacttgtaaacattttcgctacgtaagagatacggagtttaaaagctaccacctttcaggaatagtcattgatagtttcgtgcattcagtcataggggattggaaatatgtaaataatgatggtagtgagcaaggtgaaaattcaggagaatacgaaaaaatgttattaaattactttgattcacataatatacttggttttttaagtttgtattcccccggaagtaatcaatttgttgatacaaaaaatagcattatatgtcttgaaaaagttctaaaaaaaatagctttataaagttttgcgggagataatatggaagaagaaaaaaagagtttagaaatccaactacgtgaagcttatggtcgagtgacttatacttatactactcatttaaaacaagcagatagactaatttctaaaaacaaacttttaaaatgtattcaaatagggttatcagcccttactactggaggacttttaggtaagatctttactaacaataattttttaacgatttttgctggactatgttctacaatttctcttggattaaatttatattttaaaaattttgatcttgccggcgaagctaaaaatcatcaaaacattgcagataagttgtggctagttagagaaaaatatgtaagtttactagcagatttaaatcgcttgagtattaacgatattacaaacaaaagagatacattaatgcatgaaaaccatgaaatatatataagtgcctcaaaaacagatagtaaaagttataaattagcacaaagagcattaaaatctgaagaagaataattttttacagaagaagaattagataaaatattaccagatcatcttagaagaaagagttcagcaagctaaactctttcttctaagatttttttaatcttcttgtcattcagataaaaacgcgaattttttattgaacgcaactacaacgcattaattttctttgcataatcccgaattctataaacttggatccgttcaataccaacttctcgagaaatttgggctatactttttccttcttttaaaccgttaactacaccattatataggaagcgtttagacccagtaggtgaatattctttttttcttcccttatatattcccttcttcttcgcaattttaataccttgtctttgacgactgagaattttacgtcgttcttcttcagcagtatatttatatatttctaaaaccaaattagtcaacaatgctcttaagttaccatcttcgacgcctgcaaacgtgggtaagtctaaaacatctagaactgcaccttttcgtctaatttggtcaatcacttctgttaaatcacgcgaattacgtcctaagcgatccaaactcaatactgtaacaatatcatcgtcatggatataatctaggagcgcttttaattgtggtcgttctatatttttcccggatattttttcctcaaaaatcttttgtgcccctgaatttttcagagccacaatctgtcgatctaaattttgatccgaagtagaaactcgggcatatccaattttcatttttctcttaaaatctcctcgtttttgtaacaaccctattgtaacacaattgattgcttaataatcaaaatttcttaattgttacattagggtacactctattgttacatctatactgttggtttaatattataatatagcttataaatttgatttgaactctaatccggattaaacaaattaaagtgtaatagttcacacgttagcactattaacctccacttaaggcaagtttttatatcttttaaaggaaccataaataattatattccgttacattattaaggtagcgtcaagaattggattgaagtcaatatttgagacagattttaagagacattcagaaccgtgtttaccttccacagctcaaataaatcgttaatcgcgattaataacttatttgaaccctggaaagcattaaatcaggcggccatttggctcgtaagtgttgcgatttcaacttgtaagggggtctggtagcccagtgaactatgaattctcttcctattgtagaaagcatgcacatattcaaaaaggacggcagcggcagtttcataattctcaaagaccggccctggataaacccattcctttttgagggaagcatgaaaagattccattggcgcattatcatacggacaacccttacggctgtatgagtggcggatatgtagttcagttaaacgttgattgtaatcatcgctggtatactgtgatcctaagtctgtgtggataatcaggtccccagtaatggttcgatttttaaccgcgctttccagggtctttaagactaaatcagtatccatcttttttgagaacgaatagccgataatccgtcgtgagtgcaggtccatgatggttgataagtaacaccagccattacgcttcgtttgaatataggtcatatcagcggtccatttttgatttaaaccagtggtcgagaaatcctgcttaagcaagttgggacgctgttcaaccttggttttggaagccgaagccgctttccacttattgacggtaacggagtggatatccagttccttcatgagccgggaaatccgtcgtggactgcaccgaagctgcagtggttgaagttccagattcaattcatggtggatcttcataacaccgtatcgctgcttaaattccgcaaagatccgcagaatccgttgtttcaagtccgcatcttcggcccggcgttttgaaggtttgggggatcgataacgataatactgagctctggaaacaccgaggattcggcacatcttggttacctggtggtgatggctttcttggtgaatgtaatcaaagatattggttacttctgcgcaaggaagcccagggctttttttaggatttcgttctcctcagacagcgaagccagtcgcttttctatcgctttgatttcgtctggcgatttaccggattgagttttggcctggccctggatccacttatgaactgttgaatagccaatgccatattctctggccagttgggcagctgattcgccttgcttatataggttgataatgttttgtttgaattctttgtcgtaacgagttggcatgtaaaaattcctttcttttgagagacgatttattcattataccctctcttaaaagttgtctcaggaatcagcttacatccagacccagaccgcggtgacgtcgtaatcaatgtcgctatcgatggcgttggtagcaaagatgacttagcaatggccaaatttgatgcgaccatcgcttcattcgcccgtcacttgccagccaacagtaaatcaattcgtttccaagcaatccaaccgaccgaagtgatttctgatcaagccgccttacaattactattcaagttgctagatactggtcaattggtcacgacgatcgatgaacaactaccgtttaacctcacgggcttcattcaaggtcaccaacgactagatgagcctcacgtgggccaagtggtcgccgcgcgctaaaaaactgctttcaaaagttatccttttgaaagcagtttttttagtcaggtggtcgcttattaagaccatcgcagaattttgaacaacccaattcacactaatcgtaacgattgggtatatttcaaagaccgcctcaattagccaagtcctgaatacctatgcgagttggtagacccaagcctcataaggccgtaatttatttggctgctgctcgccataattactaatcaagcatttggccgtgggcgtcagatattgatccagtggtcgggacagtgtctcggctgtgaaattgcaacaaactagccaggtccgcccttcccattgccgtgcatataagaatacctgcggatcatcggcccacaagagctcaaacgaacctaacgtcactgaggggtattgatgtcgtaattgaatcaagtgctgataatagtaccacactgaatccggatcagccaaagctgcggcagcattgatttgacgatagttgggattgaccgtgagccatggcgccgcgtcactaaaacccgcgttaacctccgtgttccattgcatcggcgttcgcgagttgtcccgagaacgcgccgctaatcgggccatcatatctgccggtgatagcagctggcgctcagtcactaaaccacgataggcattgagcgattcaacatctcggtaactggctagttcagtaaaatgagcgtcagtcatccccagttcctcaccttgataaatatacggggttccttgtaagaggtgtaaacacgttgcgagcattttagccgaacgtacccgatatgctggtcggtcatcaccaaaacgtgagaccgctcgtggcgtatcatgattgttccaaaacaggctgttccaagcccgcccttcaagtccgacttgccagtcactaatgactttctttagcgccactaacggtgtcttacgcgtactccacttaccaagaccatgctgactattatcaagtcgcagatgttgaaattcaaagaccatatctaattcgtgctgatcagcgcccgcatacttcagcgcatccgctggtgtcaccccgtgggtctcaccaaccgtcatgatatcaaactgtgacaacacttcttggttcatttcttgcaagaattcatgaactcgcggtccgttcgttactcgagcatcgccaaactgactgtgcggtttcagtgaaccatctggtaatccgggtaacttagagatttggttaatgacgtccattcgaaaaccgtcaacacccttgttcagccaccaggtcatcatcgtataaactgactctcgtaaggtcggattctcccagtttaaatcaggttgttttgttgaaaacgtgtgtaaataatactgctgggtctgctcatcatattgccatgctgaaccaccaaaagccgcatcccaattattgggcgcctttttgccgttacctgagcgccaaaagtagaaatcacgatattgattggtgcggtcctggcgactgcgtttgaaccatggatgctcatcagaggtatggttaacaaccaagtccatgatgatctttaagccccggtcatgggcggcttgcaatagttcatcaaaatcagccatagtgccaaagtcggccgcaatttgttgataatcactaatatcataaccattatcatcgttgggtgaacgataaatgggattgagccaaatgacgtcgattcctaattgctttaagtagtctaggtgggccgtgatcccctttaagtcaccaataccatcatgattggtatcttgaaaactccgtggatagacctgatagacaacggcttgttgccaccacttgattgttgctgccataattacgattaactccttagttacgcggtaaggcccttgatgagcttaactggtaacgtatattttgattccagtgtacaattcgcatcctcaatccgctgcaatagtagagaaaccagtaacgtgctaatatccgctaacggttgttctactgttgttaattcagaataataatcacgtatgagcgccgtgccatcataaccaacaacgcgtaattgctcaggaaccgttaatgacagttgtcgcgcgacgttgagcactagtaaagcggtcaaatcatcactacaaaaaataccatcatactgatgttgtgtcataatcgtcttaatttccatcatcttcagcgcaggggtcaattcaaacggtaattcatggacatggggtgttagctgttgggcagtcaagtaggcttcatatccttcacggcgaccattcgttggcgaaccagcgtgtgacttaccagtaaaaatagccacgttagtcgcccccgcctgatgcaatgtctgggttgctagccagcccccctggtaattatccgaactaacgatgggaatattgtcggataagtaccggtcaaatgaaataatcggaagaccatattgttgatattcttcaatacctaaattgtgggcaccagcaataatcccgtcgacctgattagccatcaacatttgtaagtagtcgcgttccttttgcggatcatccgcactattacataaaatcaccttataatttttagcaaataagattttttcaatccgggacaccagttcaccaaagaacggattactaatatctgaaaagatgacgccaattaagcgcgtattctttccttgcagtgagcgtgccatattattcggctgataatgcagttctcgcatcgccgcgaaaactttttctttagtctgactactcaggtagccatggttattaataacccgagaaacggttgtcgctgagacccccgctagcttcgcaacatcatttaattttggtttcattgttatcgactccagtatgctctgattggcgccattcccagactttaccggtaactgccgtagtgtcaccttgaacgttaagacgactcggggtagcgtttaagaagaaacggccggtcatcacggaatagccgttatcaatatagcattcaaagactgacacatctatgattagccggatttttatcgtcttatgggccgttaactcaacttgacgagtctgaccataatcttcagcaaacgaattccccgtatgccgccgatcaatcataacctgaccatggttggcatcaacagtcacctgcagctggccactttcctgctgatcagcaatgttaaccgtgaccgttttatcagcgggaaccgtcagtaagagttcaaagctgccattcaaagcggccaccgtcgcccgttgttgctcaaagactaggtcatgcgccgtcgtccgcaaatcatccaccgctgccactggattttgatagaggtgcccatctttaagcgttagttccttaactaagctcaaacaatgggcccaattttcacgatcagttggataggaaatttcaggtaacccaatccagctgacggctaacgcgcggccatccggcgcattgattgcctgcgtggcatacacgtcaaagccgtcatccaattgcgtcagggcgtggggttcagtgaattgtgcctgagctaggttcaattgatcggcaactaaatacatgttcggataaatattctgatacgggatcgttgcttgcgataacccttggggacagaacaataagacgggctgttgatcgatccagaccagatttggacactcaatcatataaccccgcgcatttgcgggaacgttcaactcgccttgacacgtccaggtggtcagatcctttgagaaataaaccaagatagcaccgatctcagtagtcgtctgcgcaccgatcagcgcgtagtagccgtggtcattccggatcaagtccggatcacgaaacgaactcgtgtacccagccggagcatgcgcaattagtggccgggacagctttttaatgtgattatccgtgtccatccaggcacctaattgatacgattcacgttgccagtcggcagtacggacattacccgtatacataataaataactgatcatcaattggtagtgctgtacccgtgtacgcgccgtgcgagtcgtacggcgtatctggtcgaatcgctaagccctcatcatgccaatccaccaagttcttagaggtcacgtgttgccatgacttcagtccgtgtaccggaccgaacggaaagacttggtagaacaggtgccactgaccatcaaagtatgaaaagccacaggggtcatttaacagacctgatgtaggctgaatatgatgttgcatccgccacttagactggcgtgcctgggcagcgagctgtggtagcttagttgctggccactgttcataaggggtataacgggttttacgattccatatcatgacgatgagctcctttttaacgttcgacttaattgtcactattataaaaccgcttacaccgatatgtcaatcgtttgacatttttatattatattttcatgttagcgtttcaaattcggctttttaacaagattatcaagcaatccaattttgtatcaaacgcttgacatattttccaaaattgctattattgggtctgtaaagcgcttgcattattaaattaaaaataattttagactcagggagtgaattattatgaatcatcaagaagttgccgaccgcgtacttaatgcaattggtaaaaacaacattcaagccgccgcccactgtgcgacacgcctccgtttggtcatcaaggatgaatccaagattgatcaacaagccttagatgacgacgcggacgttaaggggaccttcgaaactaacggccaataccaaatcattattggccctggcgatgtcgataaagtctatgacgccttaatcgccaaaacaggtcttaaagaagcgacccccgatgacatcaaggcagttgccgctacgggtcaaaagaaaaatccattaatggacttcctcaaagtcttatctgatatttttattccaatcgtccctgcactagttgctgggggtctattaatggcactaaacaacgttttgactgccgagcatctttttatggcgaagtcagttgttgaagtttaccctggcctcaaaggtatcgccgaaatggttaacgcgatggctagtgcgccgtttactttcttgccaatcctcttaggattttcagcaacgaagcgcttcggtggcaacccctatctgggtgctacgatgggcatgatcatggtcttaccatcactagttaacggctatagcgttgcaacgaccatggctgccggcaagatggtttactggaacgtctttggtttacacgttgcacaagccggctatcaaggccaagtgctccctgttttggccgttgcttatattttggctactttggagaagttcttccacaaacatatcaagggtgcatttgactttacgtttaccccgatgtttgccattgtgattactggtttcctaacttttacaatcgttggtcccgtcttacgaacggtgagcgatgcattaactaacggtttagtaggcttatataacagcaccggctggattggtatgggaatctttggtttattatattctgcaattgttattactggtctccatcaaactttcccagcaatcgaaacccagttgttggccaatgttgccaaaactggtggttcctttatcttcccagtcgcctcgatggccaacattgggcaaggtgccgccactttagctattttctttgccactaagagccaaaagcaaaaagccctgacttcttcagccggggtctcagcgttactcggaattacggaacctgctattttcggggtcaacctcaagatgaaatttccatttgtctttgcagcgattgcctcaggaattgcttcagctttcttaggactattccacgttctgtccgtggcgatgggtcccgcatcagtcatcggattcatttcgattgcttcaaagtcgattccagcattcatgctcagtgctgtcatctcgttcgtcgtcgcatttattccaacttttatctatgccaaacgaacactcggtgacgatcgtgatcaagtaaaatcaccagcaccaacgagtaccgtcatcaatgttaatgatgagattatcagtgcaccagtaacgggggctagcgaaagtctcaaacaagttaacgaccaagttttctcagccgaaatcatggggaaaggcgccgcaatcgtgccaagcgctgatcaggtcgtcgcaccagctgacggggtcatcactgtcacttatgatagccatcatgcttatggcatcaaaacaactgctggtgccgaaattctgattcacttaggattagatacggtcaatttaaatggtgaacacttcactactaacgttcagaagggcgataccgttcatcaaggtgatctactcggaacgtttgacatcgctgccttaaaagccgctaactatgatccaaccgtcatgctaatcgtcacaaatacggccaattacgctaatgttgaacgactcaaagtcacgaatgtccaagctggtgaaccgctcgttgcgttgactgcaccggcagctagctcagttgctgctacaactgtctaaactttattaggaggacgtcatgcctgttgaatatgaccccaaaaccggcttaatcaatcttcataatgaccaaattagctatgttattcaaattttagctcatcgttacccagtgcatcgatattttggacgttacttttcaaaacaaccgtactttgagccgatgccatccggtagccatgcttttgctaatgacccaacagaacgctttccatattccgtgacttcactgccactcgaatattccactattggcagtggtgactatcgccagccagcttacgttattaaggatgctaacaatcaattactgcccattttagaatatactggtttttctgtgaatgatcagccaatcaactcgcgccaattgccacccaccgttagcaaacacacgcctgtaacaaccctagtcattcatttgaccgatgcagtgaccaagttacagatggatcttaactacactatttttgaaaatcagccgcttatcttgcgaagcacaactctgcgccatcacggtactactaatttgcaagtaacagccctatccagcgctcaactagatctaccaactgaccaatatactgcgctgacattaagcggtacccatgcacatgaagctaatccatcgtttaaccgtttacacccagggttacaaacggttcgcagtctgcgcggcactagtggaccacaacaccaaccgttcatggctctagcagaacctaacacgacagaattagctgggactgttattggttgtgcactagcatggagtggtaacttcgacagtactgtcgaagttgaccaatatcaacatagccgcctaacaatcggtcttgagcccgacacattcgaatggcagctcaaaccaaatagcagttttcagactcctgaagccgtgctaacttggacaaatactggttttaacggcatgtcgcaagtatttcacgactttagctatcagctgatgccctcccagactaacattccaagtgtgcttaacacttgggaaacactgacatttgccgtttcggagtctaaagttcaacacttaatcgaacacgcccaccagttaggcttacaaatgcttgtcttagacgacggctggtttgtcaaccgtaacggcgaaaatgggcaattaggtgactggtttgttgaccccattaagtttcctaatggtctgaacccccttgcccaacaagcccatcatcatcgaatgaaattcggtctctgggtggaaccagagatgatcaccactaacagtcagctctaccaacaacatcctgactgggtattacaatatgttgatcggacacccatcacagctcgccaccagctagtcttagacctttcgcaggccgctgtccgtgaccacttaatcactactctgacgaacttggttcaaaataaccaactcgattatcttaaatgggatatgaatcgccatcttacacaggttggcagcacacacttaccggctgcacaacagggggaactgtattatcgctatgtctgtggactttatgatattctcacacgcttgaagcgcgcctgccccaagctgattatcgaaaattgttcagctggtggtggccggtttgattttggtatgctaccatacaccaatcagacgtggataagcgatttgactgatccagtcgaccgagcaaccatcgagaacggatttagttatctatttccaccacggatattcagcaaccatataaccgcatcacccaatgcgcaaaatggccgaataacaccatttgaaactcgattacaattagcctgcatcgggcaactaggattggaacttaatcctaaacaacttgctcctagtgaacagcaacttcttcgaggagccttgattaaatatcagcaactgaaatctacttttatcaaggcccacttttatcgtctaccaacaacaagacacgttgttgcgtggttactagtaacggcagataaaaagcaggcaatttgctgttacttaaatgggcttaattctgctgtcaaaactcagcacccattaccattacactatctcgatgctgaattagcgtatagcgattcatcgggtaatcgctatacggggcatcagttaaacacgatggggattccacttaaacccaccaacgctgatttcactagtcagctaatttatttatgtcaaaattaatgtaatcgttaacaaaatttcgaattaagaatatattattattaaataagactacatttttaactacaggaggcacactatgcttttaggtgcaattgaagctggtggtacaaaatttgtttgtgccacgggcgctgaaaacgggcaagttagcgaccgaatttcgatccccacgacaacccccgttgaaaccatgactgcggtagacgactattttacgactcatcccgttgacgcgattggtatcggttcatttggccccatcggcgttaatcccgatgatccgaaatatggttacattaccacgactcccaaacccggctggggtgacttcgactttttaggccatcttaaaagtcaattcaacatcccactctactggaccactgatgttaacgaagccgcttatggcgaatcaatgattggaatcgctaaggacgtccctaacagcatctacatgacgattggtaccggtgttggcgctggcgtcattagtcagaaccacatttttaatggtcgcacttatactgagcttggtcacatgcgactcaaccggttacctggggacgatttcaagtccaactgtccttaccatgacatctgtttagaaggtttagctgctgggccagcagttggaaaacgaacggggaaagctgggaaagatattcccgttgacgatccggtctggccaatcatcgctgactacatcgcacaggcatgtgtcaacctcaccgtcgccttcgcacctgataaaattattcttaacggtggtgttatgaatcaacggcagctctttcccatgattcgtgaaaagtttgccgcctatctaaatggctacgaagaagtcccaccactggatgactatatcgttcccgctggactgggtaacaattctggcattgccggtggcctattgttagctcaggctgctttaaagaacgcttaacaccttgcaaaaaagtccgccgatacgtgtttaaacgtattagcggacttttagtttacagtcaatttgtcattcggttaatgaatatatacggttaaaacagtgataaatccaaaaatcaccccgggaacatttgaaataataacgggccaatccttataagtcttgaaccagccgtaaccagtccataatatcccattaatcattgccacgagtggttgtagcggcgatactgggtcacctgagaaattcgaaatgatttgcggaatatacgacacgtacatggtagattgtaaaattaatccgacgctgttcggacaaaaagatcagcttcctttaaaatggtgtttaccacaaacctgggactcttcggtattggtaagaagcgtaaacgtcacgatgaagaataatcgtcgactttaaagctagaaactaagttaagaaaagctctttaatcaacggttaagagacatcctaagatttgaaaaatacctgtagttagtggtaggtgatacctatcgctagcggcaggtatttttttgtggtcaaaaagagagctttatataataggaagaaaagtgtttggaaatgcaatacaaaaaacgtcgatcggcctacgttaggctaatcgacgctttttaataaaaatatatttaaagtgttttaaggatggattatttgatcaaacaatctatcaactttttcaaaggtgattttgggacatttacacaagaattctacatttcgacttttagcttgcggatccacgctcctgacttgtgaaactaagatttttccatgaactcccttagggttaggcacattaatatctactgacaaagtccgtagtttttttgtagaagtgatgggcattattaccattaaaccatcgattaactgggtatcagcaatactaaaaactaatgcagggcgcctcccttgctgttcatgaccagcagtgggattaaggttaatccatattatgtctccttgttcatagattgcttttccgtttgctagtttaaccatgaaataaacctctttattagtgttttattattaagattggcgctcaattaatcatcaattatttcattaccgacgtcagggccccagtcgaactcgcccgaattaggttcattaattaaatatccatagttttgcattaatctagattgactttgatcacgtttttttaggataagctggtctccattaacttcaatagtgatttcttggtcctgagggtcggcaattccaatggaagataataactttttagataacataattccttgagaattaccccatcttctaattttagtattgacacttttaatcatgatattccccccttaaaggtgtagttatagaacacttgataatattttctaattatcttaaatgtatgtcacttgatatatatatgttataacatatgttataacaaatcaattaatataaataattcttagatttaataaaatgcccaagattggataatgaatttgcaaaaaaacgtcgatcggtccgtttgggctaatcgacgctttttaaatattattctattttaaatacaattggtaggcaaagcgtttattatcaacttcgttttcgtcaatgaagtcaataatcccacgatactcaaatccattgttggtaataactttttgcattcccttgttaagcgggtgggtatcgacgcgaacttcgtcgtaaccaagtaaagaactaatggtgaagagaccttgcatcatcttctcagatagacgttgaccgcggaacttcgatgaaatcgcaattcggtgaattgacatatatttgtcatcagggttgccccgccaactaccttcctggatatcgtcgtagttaacatcgttatctggccacaatgcggccgtaccagcaatctgtccatcgaccattaacacataactaatttgttgctcaatatccttttcaatatcttggttagtaggatagccagcttgccactggttgatcccctgttccttcaaataagccttagcttcattaataattgttaaaatggctggcaaatcagccttagttgctctacgcaaataagatgttgtcataatttccgtctccattttctttttctgaaaaaataattctaacccaatttcgcagagatgtcaccctaaaattttcggtgaaaacgaattcatttgagatatttcctatttgggaaaattcaaggctaatattaacccattaaatatgctaatatatgtagatagtaaagaatttaggggtggtagcatgaaaaaagttcggaactggagattaaccctcggttggcaaatcctcattggtctaatcttgggagtcgttttaggcgctagtttttaccataatcaagttgctatcacggtcatgcaaaatctaggaaccatgttcatccacatgattcaaatgattgttttaccgatcgtggtatcttgtctgaccgtcggaatcgccggaatgggtgacgttagtgaacttggccgcgtcgggttgaagactttgatatacttcgaagttttaaccacgattgcgttaattgtcggaatgatttttgctaacgtttttcatccgggaacgtacatcgacattcacagcctgcaaagtacggatatcagttcttacgtggagacggccaaagcagccaaatccaacagcggaatttgggccacgttgatgaacattatcccgacgaatattttttcatcgctggctgaaggaaacatgatgccggtcatcttcttctccgtgctctttggtttgggactaacggccattggcaagcagggacagattttgattgacgcacttaccgccgtgcaagaggttatgtttaaagttaccaactggatcatgcacttttcaccaattggggtctgcgcgttgattggcgtgacgattgcccaaatgggaattgatgcccttaaaccgttgggactattcgttttaattacttacgtggcaatgcttttctttgtacttgtggtactcggcttagttgcgaagttccacaacatcaacttctttgaactcctgaaagttattaaaaacgagttgattttggcgttttcgacggctagttcggaagcagccttaccaaaaatgattgataaaatgcaaaaatacggggtgagccaaggaatcgtttcttttgtaatccccacagggtacacatttaacctcgacggctcggcaatttaccaggcggtcggcgcgctgttcttagcacaggcgtacggaattcatttgacgctcggtcaccagattacgttgttggtagtcttgatgattacttcgaagggaatggccggggtacccggggcgtccttcgtagtgcttctagcaaccgtagcaacgattggcgtaccgatgagcgggttgaccttcatcgctggtgtggaccggatcatcgatatgggccggacggcagtaaacgtggtaggaaattcgctggcagctattataatgggcaagtccgaaggtgaattcgacgaagaaaaacaccgggagtatgtgggaaatctgtagagagcggagaaacccgggtaagacttgaggactaacagaattacgggactaattgcggttttggcaattggtcccgtaatttagttagccggagagtcttgggtttcggagctcatttcggctgtgcagcatagaaccccaaaggattaacggaaatagggaactaatcgcgatttaggcgattggttccctattttggttaaccggaagaaagctaggggctggagctcatttcaactacgcagtagagaagcgtagcggaattgaggtacaatcgcgatttaggcgattgacggcgggattttattaaccggaagaagttgggttgtggagcacgtttcggctgtgcagtatagccaattaaaccaagagcaggaaggcccctttagtttgctttcaatgattaaaaatggaagtatacttccaaaatcgttttatttctccaaaaatggaagtatacttccattttttacaaaattactactaaatggaaatatacttccatttgataataaaaagacgtaagatggaaccaaagataagcatcaatgagggggcaagtaaatgattaaaagaccgagttatttaaaaaaattaattcagttgaaagacacggacgtaattaaagtgatcacgggtgtgagacgttcgggtaagtcggtattactaatgttatatagagactacttactaagcaacgggattaagagcgaccaaataatttaccttaattttgaacaatttgaactcttaggagtccgtaatcaaaatgagctaattgaattacttaagccaaagttaaataaaaaacagcgcctttatttgatgtttgatgaaattcaaatggttgacggttggcaagcagtaattaatgggattcgggctagctataattgtgatattgtaattaccggttccaatgcgcagatgttgtctggggaacttgcgaccctactaagcgggcggtacgttgaaattccaatttaccccttttctttccaagaatttttaacggctaaagaaattgacccgcaatcaagggaagttgatcaagctttccaagaatatgagcagtttggtggttttccagcagttgttctagcaaatcaagaaattaaggacacgattttatcgggaatttttgacacaatcattcttaatgacgtgtcaatgcgggctaaagttcgggatcaagaatctttaaaagccttagtagattttttatctgataatacgggacaactggttaaaccggctaacgtggcgaatgtcctcaaaagtgagggaatcaaggtttctaaccacacaattgaaaattatttggaattactagaaaatgcattcctattttaccgagctcgacagtacgacattcgtggaaaaggttatttacgaactacggggaaatattacattgttgaccctgggctacggcggtatgcggtaagtcaacgtcccggtaattatgcaggacaactagaaaacattgtttacgtggaactgctaagaaggggctacaaagtcgacgtaggcaaactccagagtaaggaaattgatttcattgctcgaaaacatgatgaaattatatatattcaagtaacgtatgaaattccagaaaacacccatgagactgacaatttattaaatttacgaaataaccaccaaaaaatcctaattacgcaaaagtattatccggatattaaggaaattgacggcatcccggtaattaacgttgtagattggttgttagatgaacaagaataactatgctaaaaagcgggggaaaaattactttggtgttttgactgcactaaaagtccggttgttccgcttaactaaaaatcgactattatgccaaatttagacataatagtcgatttttagttaaattttcataaattacccggcttttgacgcacgttcttttttaccccaattcaaccgtgaagttcagcagtcgactaacgtagttcgggtggtgattaagttgttgaatcgtgcgctgaagggtttctaaattatcagtaataatcccattaacgcccatgaaggtcaatttggccatgacgtcgcggtcgttaaccgtccaagcgtaaactttgcgaccggtaagctgggcggtaattaagaaggagttattcaaggtagaatgctccatcgtataaaaatcggctttagattggggcacgccgataaagttaaatggcaggatgtagccaacttggagcttagggttcaaggtttttaacttttcgacggcatcgtaatctaggctgtggacctcgtcgtggttggccacgaggcgtttaccgtagcgtttattaaaggtggtaatggaattggaagaatcccgtttcgtagtcttaagttccaccagtaagcgctggtgcaaacgttcggcggttgctaagtagtcgtcaaagctggcaaccttcgcagaagtcccgttttcccgagcagttaagcgggtgatttgccgaagcgtcaagtcatgcggccgtttattgaaaccggtcaattgttttaagttctcgtcgtgcattaccacaaactggtggtccttagtttcatgtaggtccatttcaatgaaatcgggatgcaaccggctggtgttaatcagagctggaatggtgttttgcaccccatttttcgcgttaactccgcggtgagaaatggttaacggcgtggaagtgaaaaagccgttcaggtaaagggcgttaaagccgaggattcccaagaataaaacccccgccaaggccttaaaccaccaatgcttgcctgattgataactaagccgttggagctgattactgagctgccggctactagtaacgaagctagcttggtttttgagttggtcagccatgatcatcaatgaaccagttcctaaggcaatgctcattaacaggagtaccagctcaattaagagcaggttgatggaagctgcccaatagtcccaagaagccggaagatgatggtcagccagagcctgaagcgctaaaataagcgcctgtcccaaaattgacagaccgacgttgactacgattaacaatcccagttgcttaacaatggttttgaagttcaatttggttaaccgccagcttttctggacggcttggtgtcccgtgctgcgtcccaggataatcagcggaagggccaagaagaaccgaattcctaagtaaaaagtaactaagtaaagcaaaatcagcactaaaagcaggggccgattttcgtatagaaaatagttaacaatgaagtcgggtacccgcaccttgttcaataacggagtcgagatacccagccccccaaacggcaggataattaaacaatagattaataagtaaccgaccgcgcgaccaaaagtatgccgtacccgttggaaagaaagggtgattagcgaatttaaggctaattttttaccttgattaatctgcataatgcctagaaataagaaggtcacctgccagtaaatggcgacgatcacggcgagaatcaggagtaggcaaccgatgtctaaaaacggatggttggtgaccacctcaacgaaattggtgttggaaaggtagcgcacccccgccaaacgcaacatgatgctgccaatcaaggtgaaaagcgggataatgcccgcgtaaatcaccacgatactggtaataaataggctgagatagctaagtaaatgtttaaaaataaaacgatacgttttggtgatgctcgccataaagggcctcctagataactgttcttcttgttattctagcagagaaagtgcggtatttaaaacgctaggagggtagcgaacgacgaaaaggggggcgatttacgtggttgactgtcctttgttaattacgacctcggcgaagccacggtcttttacctattaaattttttaggtgttttaagtttacctttatggaagaacgaaaatacaagactgaaatggtccttaaaaagttgttttgacttcaacggcgccgaaacgggtaccaaaagtcagtttgttccgcttaaccaaaaaattggccattatgcaaaattaagcataatggccaattttcagttaatgtaatgctcgcaaactacccgactttcgtcccactcgcgtatcgaatggtttgaattttatagtttttgtgtagtaaatgctttcttcgctgcatcatattggtgaaggtaacggtgtgcaccgaactcctcgaagaaggcgtttggctcttccggattagggtagaagaaagtttcctcatcgcccttaacgactttgattcccactcgcggggtgtcgaccgtagttaaacgagtggtcggtgaggataggtaggtggcgatatattttttaataatcgtgaggtccatattcgcaactccttaatttaaagtacgtcacgcgtctgcggcgtatccagaatgtaattgttaattaccttggaagaaattgccggcgtctttgccaaaatcgattgcgcgacaattgattgggacagttgttcttgataaaaatcatttggcacaaactgactaatacttaaaacaatgaaggtaatcagataactgattacgaatccagcgacggcgcctgccaagccgttgacttgatgaatgacgggcaaccaggtgatcatttgtgaaaaccggacgattaagcgaatcacaatccagcccacaagcatcaagaagatgaaggaaacggcgttcatcgtggttaaattagtcaacgggtcgtggctcccgttcccaaaagtacgggagagaaattcggcaaagggggcggtgaagtttttggctgccgcaaacacaattaaataacccactagataaatgatttcggcaactagtccgcgccggtagccggaaaaaaaggccgaaatcaagattaagattaaaattaacgatagtagcattaaaagctccttgttgaattagttggttaactaaccataattaaggttagttaggtactatttattagattccctaacgtcattactcgttagtgagtgttcgatattgacgaggaaaactgggtgttctgaagacgagacaccttatataaataaccactatagaggaaaaaacattgctattcaagttcaattaacccggttgaagttcaatttaagttaaaaatgaagttcaaatttaacttaaagaccgcgtaaattagccgttttcggcaacactggttctaatttcggcttcttgagaaaagcgtctttacaaatccgttagggaagaagtaaaattgataagtaatttaaaatgattctaaattagcgaacgaaatggggagaaattggatgagtaaaaaggcgaagcaaaatacgttagcacaaaaaattaacgtaattcgggccagcgtaatgggggccaacgacgggatcctatcggtagccggaattgtgttgggcgtggcgggggcgacgaccaatagctttgcgatttttatttccggcatttcggggatgttagccggaacggtttccatggcgatgggcgaatacgtttccgtaaattcccaaaaggactcgcaggaaaacgcggttaaccaccaacggcaagcacttgaagaggactaccaaaaggaacttgattttgttgccgaaaagtacgcaaaaactggcattcccgaggacttagcccaaaaagcggcccgagagatgatggaaaaagatgcgctattaacgaccgtgcgtgaacgttacggctttgatatgcacaattttaccagtccttaccaagcggcgattgcttccatgattgccttttcgttaggttcgttattaccattactgacgattacctttgctaaacacagtattcgggtgccgctaaccgtagtttccgtggtggttgctctcgccattaccggttacgccgcggcggtgatcgggaaggcggtccggcggcgagcggtcgtccgcaacgtgattgccggactattaacgatgggcgcgacctacctgattggctcacttttcgcgcggtaaggggatgaatgaacatgaaaaagaaaactaaaatgagtatggataacaaattaaacatgttgcgggccggcgtattgggcgctaacgacggaattttgacggtagtcggggttctttttagtgtggttgcggccaccaccaacccattcatcatctttattgccggcttgtccgaccttttgtcatgtgctttttcgatgtcagcgggcgaatatgcttcggtaagttcccaacgcgatactgaaaaagcggctgtgggcgaagaaaagctccggctaaaggctgatccggaagccgaatatgaattagtggcgaatttttacatggaaaaaggggttacggaagagaccgcgcaccaaattgcccgttcattaatggataccgcaccgttaaaaacggcggtcgacgtgcgttacgacatggatttagacgaatacctaactccgtggggtgcggcaatttcgtcactattttctgcagcgctaggcggggtctttcccctagtggcgatgaccctcgcacctagtgattttaaaatgcaggcaaccatcattgcgacggtgttttccgtagcgttgaccggcttcttgagttctaaactgggaaacggtttgccgaaaaaagcggtcatccgtaacgtaattgtcgggatcatcacgatgttcattcattactacatcggaaaattattttagtaagctcaaaaaatcgcttccagacttgatttataaagtgaatctagcagttgaatgcccgtctaaaggcattttgcggggttgtcaaagaaatcttatatgttatgattgctgtggttcaagattgaggaaaggaaggaatttaaaatgagtaacgagatcaagaaccctaagaagcggcgaaaattaatttcgtacgcaaacggccgttcgttggaggaaatcaacgggacggttaaggttcctaaaaatattggtttttggaaaactttgtttatgtattcggggccaggcgcattagttgcggtaggttatatggaccctggtaattggtcaacatcaatcactggggggcaaaacttccagtacatgctaatgtcgattatcttgatttcgagtttaatcgcgatgttgttacaatacatggcggctaaactgggaattgtgagtcagatggacctcgcccaagcaattcgggcgcggaccagtagagcactgggaatcgtcttgtggatattaacggagttggcgatcatggcgaccgatatcgcagaagttatcggggcggcaatcgcgctttatttgttattccatattccgctcgtggtggcggtattcatcaccgtatttgacgtattattgctattattgttaaccaagatcggtttccggaaaatcgaagccatcgtggtttgtttaatcatggtgattttggtcgtcttcgtctaccaagtagccctttcgcatccgagctggggcgcggtatttggcggattgattccaacgactaaagcatttgcaacaaccccaacggtgggtggcatgaccccgttgagcggttcgctaggaatcatcggagctaccgtaatgccgcataacttgtacttgcattcggcagtttcgcaaacgcggaagattaaccacgatgatgaagaagacgtagcacggaccgtgcggttttccacttgggattccaacattcagttatcgtttgccttcgtggttaacgcactgttgttagtaatgggagtggccgtatttaagaccggtgccgtacaagacccgtccttcttcgggttgttccacgcgctaaacgacacttcgacgttaagtaacggaattttgattggggtcgctaagaccgggattttatcgaccctctttgcggtagccctcttggcttcgggtcaaaattctaccattaccggaacgttgaccgggcaagtaatcatggaaggtttcgtgcacatgcgaatgccgttatgggcccggcgtttgattacccggttgatctcggtagtgccagtattaatttgtgtaatgataactagtgggaagggcaccattcaagaacacgaagccctcaacaacttaatgaacaattcgcaggtcttcttggccttcgcgttaccattctcgatggtaccgctgctgatgatgaccgacagtcgcgtagaaatgagcgaccggtttaaaaacagctggattgtccgaattttaggctggatttcggtaattttcttaacttacttgaacctaactggattaccagattcaatcgcggccttcttcggcgaaaatgccagcgcagcggaaattaacatggctcacgacattgcctacgcgttaattgtggccgttttggcattactcgcgtggacggtaattgaattgtacaagggaaataaacgttacgaaattgaacttgcagaaaaagctaacgcaaaggaggcggcataatggccttcgatgtgaaaagaattttagttggagtgggcgactctaaagacgctttgttggcttttgactacgcaattaatttggcgaaagatgccaaccgcgaattggtgattgtttcggtgctggaaaacgacgaaatgaacgttttccaagccctcgacaaggattacattcatggggaacgagctgaattagaacaacacattttgacctaccaaaagcaggcgcaagatgctggcgttaccaacgtccgttgcgtggtgacggaaggcgatcccggtgagacgattgttgaagaagtaattcccgcggttaaaccggatttattggtggttggcgcggaatcgaaaaagggcattgctcgtcgttttgggagccaagccgcatacatggcaaaatacgctccgattacggtaacggtcgtgcggtaatttaaattttaatcaacttaggaggacggcaaagcaattaggaacgtcctctttttttatgaacgggggagcaaagtgaattttgtaattattggactaacttttcttagcgtcaatttagatttcttttttatgctgttgtttttggtccgcaagtaccggttgtccgcagttttagggggatatttgctaggcacgttgctgttggtgacggcgagttatttaattggccaaaccctctccgcctttttgccggaatggttactgggagtgctcgggttcttgccgatttacctagcaattaaggatgacgatgacgaagttaacgcgacccagtccggtgcttcggcagtcgggacggttttggtgacctatctttccgtgtgcacgggatgcaacctggcaatctttttgccagttttaatgcacgcccagcttgctgaatttttcgttgccttgttattgatcttgggattgagcgcggtggccgtcctcgtgattaattcacttagcaaaaatccgcttgtcagccaagtgatggaaaaatatggcgaaaaactgatgaaggtttgctacgtgttgattggactgtacgttttctgggacagcggcttagtggcccatttaattcggttggttggataaccggtaattgataaggaaagtaaaatcgaatgatgcacccgcatagcgcaaaaaaagaccccgactagtaccagtagtcggggtcttggtgattctatgcttgccacatgactgcatctagagtataacacaatcatttgatgacttgctaccattttaagtaggatatttaatatgttttgaaaaaataattccggccaaaaacgattcgtattgaatcgtttttttgggtttctaaggaagacaaaaatccccgctattatcgcgaatagcgaagattttggagcctgtggtggttgcacaagatctggaagactatccaaattaaacaaagttaacttggaaagtttcccggcgggtaaccccgtcagtgcgaacttgtaggtgatcctgttgggcagtccgagtcacggcaaaacttggatggtagttaccataaaaatgaaaatagaatttattttctgaatctggtttcgcggtgaccaagcaggctgaatgatcggaagcccgtacaacttggttagcaacgttggtacgacaattaatttgaaccataaacctcgcctccgcctctagcttaacactattaaaggttaatggtgcaagctgctaatcattattagcaatttctttttgcaaagtatctaagaataggcgatttaagttaggtaactggtgatttttactccacaccagggtgttaggttccacaaccgcgggcgccaagggccgaaaaacgaggccatccttggtagtgtaatgatcaattaatttatcgtaggtcagcgccattaccgcgcccgtttgaactagcagactagcgttaaagatgaggttgtacgtgccgacaaagttaagctggttaaaaagttccccgctccagatttggaaagttccccgttgtgcggcctgccgggaggtgattagcggacggccaaccaagtcgattggctggatcacgtccttttcagcaagttgggcatccgctcgcattagcactccccaccgattttcttcggggagctggagggtgttgtaattattgaggttatgatagcccatgagaacgccaaattccaaaagcccggcatctagcccggctaaaatgtcctcataatcgccactccgcaaattcacccgaacttccggatattggcgcatgacttggtggagagtttccataaggggcgtgattccactgctttccccggcgccaatttcaatcgtgccactgatcacatcttgtttttggaggtgataggtagtcttattaaccaaccccacaatctgttgggcacggcccagaagatagtgaccttcctgagttaaggccaaatggcggtgctcccggcgaaaaagtttaaccccgagttcgtcttccaagtcagcaatttgtcgtgaaagcgcgggttgggaaacgttgagtaactcggcagcccgggacatgtttaactcttgagcgatggtgacgaagtagcgtaatacgcgaatatccatgatggttagctcctaactataacaaattgttatcaaaaatcatgtttaataagtatttaacattactataaaaccccgctaaactatagtcaatcagttatttgagtagcaaggggatgagcatttggaatctaaattggatttaggtaccgccgcttatagtcaagttgacgaagtggtaaaaactaatcaacgacttttacaacagttaaatactcaggagcattcggctgctgaaatccgtcagctagtcagtcaaatcactaacgaacgaattgacgacagcaccgaaattcggttaccgtttcgcacggattttggccggaacctgcatattggaaaagatgttttcattaatagcggggccatgtttgttgacctaggcggaatttacttgggcgatcacgttttaattgggcctaacgtaaccatcgcttctgttaaccaccggatggcaccgcaggaacgacggcatttgaacctaaagtcggtgtacattcaccaaaatgcctggctaggggctaacgtgacggtgactcccggggtagtaattggcgaaaacgcagtggtggccgcgggtgccgtggtgacccgaaacgtaccgaaaaataccgtagtagcgggagtacctgcccgcgtaattaagaagattagggattaggaggaattttgggatgagtttgcaagataaagtagtagtgattatgggagcttcaagtggaattggcgcggcaactgcccggcttttagcagaacgcggcgctaaactaaccctagctgcgcggcgattagcacgattggaagaaattaaatcagcatatccagaggcctcaatcgaaaccgtggaagctgacgtaaccgacatggctgcagtacaagcagtaattgatcatactgtggcaaaatttggccgggttgacgtactttttaacaatgccgggatcatgccggttaacaatttgagcaagcttgctcaccaagaatggcagcaaatgctcgatatcaatgttaagggcgttcttaacggaatcgcggctgctttaccagtgatgcgcaagcaaaaattcggtcacgtaatttcgacctcttcagtactgggttacgaagtgttgcctggttatgcggcatattcaggaaccaaatttgcggtacgcgcaattatggaaggcttacgtgaagaagaacgccaaaatagtattaagacgaccgtaattgctccgggatcggtaaaaacagaattatttgattcaattaataataaagaggttcgcgaaagtttaaaggcggctcaaaaacagccgggtgcggaaatgatggcattggaaccagaagaaatcgcccaagcggtagcctttgtgattgacacgcctaagaatatggcggttaatgaaatggtaattcggcctacgggtcaagaagtttaggaggaattttgagatgaacatttttgaagaaagttttacgttaaataatggagtaaagattcctaagttagcattaggaacttgggaaattccggatgatcaagttgccgaagcggtgcggcaagccgttaaaatcggctaccggcacattgataccgcgcaagcatatggtaacgaacgcggggttggtgaaggtgttcgaaccgctggcataaaacgcgaagaccttttcgtgaactcgaaagtggctgcagaaattaaagactacgaaggcgcgaagaagtcgattgacgaaaccttagcgaaaatgaagttagactacttggacatgatgattattcataatccgcaaccatgggtcgaagttaaccaatctaacgaccgccattttgcgggcaacgtggaagtttggcgtgctctagaggatgccatgcgcgctggtaaactacgggcaatcggggtttccagttttgaaaaggaagaccttgataaccttacagcacacagtgataccaagccaatggttaaccaaattttgactcacattggggcgacgccagaagacttaattaattactcgcaagctaacgacattgtggttgaagccttctcgccaattgctcatggtgccgcaatgcataacgaagccattaaacaaatggccgacaagtacaacgttagcgtaccgcaattatcaattcgctacgcatggcaattaggattggttgttttaccaaagaccgctaatccagaccatatgcgtgctaacgcagagctagattttgaaattagtgacgctgatatgacaactttgaagcaaatgcacgggatggattatggggatgccgacatcttcccagtgtttggcggcaagatgaagggttaaaaactaccatataatatgataaaaaatagcgggagtcagaaattcattgtgaatttctgactccttttgcgtatttttgtatttaagaacggaaaaagtaaaatagataacttaaatctacagttcgtgttattatagtggtgcagtaaggaataagtaaggaaaaaggagcgacgatgatggcaaaaaacttaactaaagttcgttctaaaattactagcaaaaaccaagttacaatcccaaagacggttcgtgacttattaaacgtaaaatctgctgacacgattgaatggcaaattgagcctaacggaacggtaatgattgttcaaagtaagccggatttatggcaagtggttgaccagcaagctcaaaagtatggaaaagttaatactccggaagttgactggggaacggacttagaaagcgaagattttgactgatgaagctaagccaaggtgatgtaatcttgattgatttaaacccagctaagggaacagaaacgaaaaaaagacgtccttgtttggtagttagtaataatcattacaatcgttatttcaatacggtacttgttgtaccaatcagtacggcagaaaaataccgggtcgcggaaaagtatgtaaaatcgccgttatttatcccaattgatcagggcgatattcaagggacggcgttattgcaacacgttcgggcagtggatcccactaagcgctccaatgggcaagtgatggaaaaaatatcatcagctgaaattgaacaaattagcaataatcttcagcaatttttttaattagagcaaaaaacgggagccagaaattcattgtgaatttctgactcccgctttttagtgagaaaatttaaattatccaactagttagttttcggtttagcttcaacccaactagatagcaagtagatgttgattgcagaaaaaatcagcaaagctatcagtacgtagaatgggctcaagtaaaattgaaggtcggcattagcgttaagtaaagcagtatgatgctgagcaattagcataaatacgctacttattaactccacgatgcgtccaaaaatatacaaaatgacgattaccaagatgatttttgaaatccgttgtccagcccttggtaagaaattactgatcatctcggtaagtagatgaactaaagtaatcagggcccagaagtttaataccgcgaagataagggtcaggatgattgaaacggttagcataaaagttgaacctgaaaaaccatctacaaaggttttgattgtcatgtgccagtgaaaaatcaacgcaaagatgacaatgcataatccaaagtaggcaaaactaaggaaggtggtgatcaaatttgcccaatataatttaccatttgaaatgggaattaaccggtatgtactggcggtgtagacgcgttcgttacgaatggttaataaaatataaagaagcatactagctaatcccaaaacggattcaaaggtggcgaagagtgcgccaggggctgcggatatgcggatcatttcgtacagcgtaacgacgaccgcagctaatgcgctgaatcctagtacttggttagcaaggcggaatttttcttggaacattgccttggttaaatcaaaaaatttagtcatattcgacatcctccttgtagaaatcttcgtagtaggactcgatatccttaccgagcgtctcgcgaatcgtgtcggcccgttcttgggcaatcacgcgttggtctcgcacgatgacgacttcgtcaagtagattggcgatgtcggtaacgtggtgatcactgataattatcgtggcattttccggtttccagccaatgatgctactgataatttttttacgactcattccatcaatcccgtcaaatggctcgtccagcaaatataggtcggtttggcgtgcgagggtgatggcaatcacaaatttacgctgattccctttggatagctgattaagtcgggcgtctagttttaaattgagggtgtctaacaaatggttaaaacgggataaatcaaaatcggggtagatttgttgataaaattccgcaattttaaataacctttggttgtttgaaagactgctaacctgttcggtaaaactgacagattttttacgagttactatacgagtatcgccgttgatcatgatggaaccttgacgagggatgtaactgcccgcaattaagcgcattagggtggttttccccgccccgttagcaccaagcaaaccaacaatttcgccttgaggaagttcgagattgaggtctttcaagattgaatgcaggttacgttggtagcttaaatttttaatgttcagtagattttccatgatcatcatcctttctcttggcaatgtaacgggacaagtaggtcaccatctcgtctggctctatttgtagtctaagcaagtgatcgtacaactgtgaaagttgggattctactacagtttggcgtaagttttgtaaaacagcttggtcttccgtaacaaagttcccctttccacgttgagaaattaaaatgccatcttgaataagttctcgcaaggcccgttgcatggtgtttacgttaaccgtcaaatcaaccgcaaactggcgaactgcgggaattttagatcctggagggaaatggcccacgatgatttcttggtaaatgtattgtttaatttggtagtaaatcggaatcttgtcatcaaaatccatgttacgtgcctcctttgtgtattactatgctattacacagtaacctaaattagataatttagcaagtgattagtgaaaagtgtcttcaaattttgaatggatgtatttaacgcggacaattaaaaactagcaaaggcaagctaattgactacctttgctagttttttggtttgggttgatgcggtgagttatttgtggaaatctgcgtaaattgaactgcctaataaaatttcttggtgttggttatcgtggtaaagattggtttgtagcaaaagcgtgtaataagcttgagggtcgttatttacgcggtccatcgcatctacaattgcttctgtgtctggaagggtccccaagaagttgccttctgaagtttggttaaatgagaaaaaactaccaggtgaaagaatcgcatagtcattagatttagctattaaggcactatttactacggagtttaaaaatagggattgatcaatttctttccaaaaatcatcattagttacgttgatggttggagaaagagaattactgatatcaattgattcagtaaagataggtgctatgtgattactatttttagtgtagtttgcgcgtaaataataaacgctaggaagagttttaacatttccctttgggggaagttttgcatcgattattttttgagctaatcgggagttaccaaccttatcaggattaatcaccagaatatctcacctatcaacattttcgtgcaattgagcgaagttgatctgcattgctcgggaatcatccgctactgagatttccatggttactcgagcttcagggttgaagtattggagcccttcacctatgttaggggtcatctcacctccggcaaacgtatcaatatcaatatcaaaaattgaaccatcatccacggaagccagtaggtctttggtaatatcattaacggtgctgccttccgggaggtagccgttctgaattagtaaacctaaaatagcttcgcgtaaggaaggattaggcatccaagtctcaatatcgctgtcttggattttaagttgcttttctgagagttttggcagtttttgctgttgctgatttattttttgaataattgctgaagcattaggttcgttttggttgaattcagcagccgaagccccggtattagtgataattggggtaatgaatcctaaagcgattagggcggttaacatcgattttttcatttgaaacacttccataatcacgtattaaatacgtaagtacaaagctgaaatggttataaatttttagtctaggttggtttatacagtacggaataccgagcccatcggagacaccctccttcgtaaatatttatttcctcttgtgaagggcttaataatatcatgtagtaaatttgaacactaataaaacgcctcgataaagtttattttaatttgcgaatgcaattgagagaaaaattagctaagcaaatattgctatataaaaacatctttgataaacatatctaagaaattaaagggatggggcgattggaatggctgcccatcttttttgattaggtttaataaacaacaaaaataaattattttaaatggagagctttcggtggctttcttactatgataatatttatcgaagatatgtgtatttaataacactaggggggtagcaatgttttgtcaaaattgtggaacaaagaataagcctggagctaagttctgccgaaagtgtggaaccgcgttacgtcagccaacgacgcaaccaactccagtgacctcgcaaaatgcatcgacggcgcctcaaccagcacctaagcaaccggatcctaagcaaactgcaccggtcgaacctagcgtgactcgggaagaacaccaagcagcagtaaaacgtaagaagcgcacgggatggctttggattacggcagggataattttagcgattggattcgtgggcttttttatctacaaaaataatcccacaattttatttggcgctacgcattcggatcaggcaaaggttgcctcgtcaaaatcggcgtcttccgcgtcgacggcacctcagaaaaagacctcgtcggcgccaactaaaaagcatttggcgtttcctaagagcaccgtggaaggtactattcaggatgcgtttggtgacatttcgggagatactgccgtttacgtatcgccggttgattcggataccgaagttgactccaatgaccaaccgcaacgggcggcaagtgacatcaagttatttgtcatgattgcggcttaccaacaagtcaaagatggggagttaagcttatcggatgactatacgttaactgatagggataaggtagacggtaccggtaaactgcgggaaatggcggacggaaccaagatttccattaaggatttgatcggctacatgatggaagacagtgacaataccgcggcaaacatcatgattcgcaagttaggtggcatggcggccgttaaccatcagattgataaaatgggagccaccgacaccaagttagagcggatgttgatggacacggatgccttggaagatggtaaggacaactacacgtctgctaaggatttgggcaccgcgttaaagaaaatttataaccatcagatggtttcccgaaagtacgacgaagaaatgctaactattttgaagcaaaacgaaaatcatactaagttgccgcacgatttgccggctgaggccacggtttacaacaaaaccggggaatttgacgactacggagtggaaaatgacgctgcaatttttggtaatcaaaagggcgcctttgtcatcgtagtaatgtctcaagacgggcaacgtgacgagcaaattaacgcgatgaatagttttggttcagtaatgtataaaggattattagagtaggagtgaaggaaatgaaattttgtactaaatgtggaactgcaatcgaaccaggagatcaattttgcactagttgcggtaccccggtagcccaaatgcaggctccggaagcaccagcgaattcagcggcagcggaaaaggtgactgaaaagccagcacctacccaagaaacggtaaccacgacaactagcgctacaccagccgcaactgatttgaaggctgaaaaaacggcggccaccacggcagcacctgaaagcgatgcggtagatgaaaccaaggccccaacgtctacgactcaggcccaagaagccccaacgaccgcagccgcaactgctaaagagacagccaacgacgcgaactcgacggcaacttccgcaaccattgataaagagaaggttagcgcaacggtggatcaaaccaaagaatatgcgaaaagctactggaactggctaaccacgtcggtcaaacatccgtttagttacccagaaaccaccaatccgctatacgggattaccacttttataatttttgcaattgttagcgcactaatactaatagtttcgggacgccaaacttttaacgcgttggatagtaaagttaaagtaagtgtaatcatggaaaatccctttactttcggggtatttctaaaattcctcgcaatttttgcggtgttgtttgctttgatggtattggtggggattttagtcactcaattcttaggagcaaaggggcagacggttacttggttcacttacaccaataagttagcgcactttgtaaactacgtcttggtactcggattactagccttgggaatgctttttgcggctggtcccgaattggttgacgaagttaccactgacatgccggatattttgttccgggcgttgcttggaatggccttggcaggcttaaaccttggcttcattgccaccttcttcgaagaaaaattgaagtttgaatttgaccgcatttacgtagccatcttagctgaagcagtgttattcatcgcactttacctaggagtggaacacctcttaatccccgcaatcacccaggtgggaactagctttaactaagaaaaaatatttgtccctaaaaagtttcacattcttttatccgataggcaaaagtgctataaaagagatattcgaaaagaaagagggacaaagtatgtgcacgagtattgaacttactgcagaaaatggtgccaaattctggggccgaaccatggatttagcaatgacgatgttcggtgaagatggaggtgcggaaagcgtgattaccaccatcccagcggaagcgaagattgctagtcaactgactgattggacggccaaatatgccacgatgggagtcggagttaaaggcactccaatcttatttgatggaattaacgaagctggcttagcgggcgacttacaggtgctgtttgaaagcaccgccgattcgttagaaaacttgaaacagcgaggattaacgccgctcatgaacacggaatttgttacatacgtgttaacccatttcaaaagcgtggctgagatccgagagcattatcaagaattggggttagcagatcaagcaacccaagttaacgggcaaggatttactttcccgctccattataatttcgttgacgaaagtggcgacggagtagttttggaaccggtcgaaaacggagctttcaagttgtacgattcagttggagtagtaactaacagccctgaatacagctggcacactaccaatttgcgtaactacttgggattaaccgacgtagacgtgaaggatccgcggaattataaaaacggcgtaaccttaccaccaattgaaggcggaaccggctacggaatggctggacttcctggttcatacacctcaccagcacggtttgtccgtagttttaccatcgcgaatgcaatggatgatttcgctgctgaccgcggaattgcccaactttacgcagctttccgtccggtaattattcctgaaggtatcgaacgcaagacggctgatgcaccaatttctgactacacccgctactggtcaggatatgacctccgaaaacgggcagtttacgttcaaaccgggttaggcttggcatttactaagcaaacgttgaacgcggatgcgcaagaaattagttataccactattgaccgtggtgactacgtgcacgaagtttaatggatttgaagttaaactaaaaaataaacagggcccagaattaattctgggctctgtttttctttatgcaaagagaaataatcccatgatttaagacaattaagttcttttggagaatggttttaaaatggcactgctgccaaagttttaccggttattttgtaattaaatttcaatatttcaataactaacgacaattaatccaaaaataaaaatggaaattttcaaaaatctgaaaatttccattttttcccaatcatttactgattttaagcacggtcgtggaaccatttactgcttgccaaagcaataatgtcgtttagcaagtataggcagtaggtaaagaaaagtacccaaacgggatgtccggcaatcgccgtcacgctccataaagtgatgctcatgatgctttgcgcaaaccagaagtaatagctggaacggaagcgccgcaccgttagaatggccccggttaagccaatcgttgcgctaagcgaatcgatcactggacgtggactcgttaggattacggtgtctaagccgtaggtaatcgcccaaaaaatgataaacgtcactacggtttgcccgatgtatttgccggttagcaaacgtggagaaagtccttcgctactgttccagttcttattgagcacaaccggaatatccaagaggaagatgtaggcggtttgcatcaccacgtcgctgtagttgccggtaattgaggctacgtagatcagcatcaaggcggaaacgaatcccaacaccccgttgatgggtttgccgttggtaatactcaaagtacacgtaaaaccaattattccagcgatggtggaagtgattccgagggcgttaaagttgtggtataggcccgttgctaaaagaaaaagggtaccgcaagctaataatatgtagctcgaagtcatccacccgctcatctggtccttataccaatgcaagttaaacacccgcattggtgattgaggattgtaacgtaaatctgtgtcttgtgtactttgcaaaataaagtccttctttctatgatttgtattagcccggtagaaagctgattcaggcttaaaaaacttattaaaaaagcagtacccaaatagtatacgcggattaattccagaaggcaagacccgtaaaagtttactagaccaattttgcgataaaaggaacccgatgagaacgggcttgcagtgaaataaattactcgtaatcgttatgatgaatttttttgtggggaattggtatagaactaggttgtgagaataatttttaataaattgatacgacataaaacgctcaacggttttctaggaacgacccgttgagcgtttttaagaatccgaatgtaaagtttttaaacttactttagctaattttacgattaaacataaaaaatcatcagttgccgaaaacagttgctctgttattgctacagatggtttccaggaagagcattattaccttcatcaagtaaaacatggtcagaacgattgtggccaggcctgggcaattttttgggctagcggagccattttaggacgattagtttttaaataactgatgtaaaattccatagttgcagtttcgtcattaaccggaataggaacccgatcgtccgtatcacttagcgaagtggtgtattctgaatcgaacgaggagagattagtcgaaaagtaaggaaagttagagtacttagtgatttcattaaacgcaaaccgttgtgcttgatacatgaacttagcttcaggaattttttgttggataatggtttgccatgggccgatatcagtaagaactacaaagttgatgcccttcagttctctaaaagatatggaagcttggttagagtggtacataaatttatccagatgaactaccaacgattctttgcctagataaacagattcaatatctttattttgtatttcttggttagaaataattcctgtaaaccggttatttaataagcttttaattacattatcagtatccaatagattttgcgtgatatttaattgggccaccgaaagtctgttaagtaggagtagcggtccgggggcggtcgacgcaattttaattacgtcttcttgatccgcaaaattccggatttttttaattgcgagttgctgacgttgcaggatttgctcaccctcttggacagctagttcgccaattgtggttagggtgagcttattaggttgatgatcaaaaagcgatactcctaaggtctcttctaacttttggagtccccgagtcacggacggctgggtaatatgtaaggtttctgcagttttagctagagtaccagttttagcgaaaacgactagttcttgccaaaggtaagtatcaatcataaaggctgcctcctgcttagtatgtcttaaacgaatactagcatgtaaaacaagcaattttcaattatttttttgcacgttaggataattacaatcagttttgaggaggagattgtaatgataaaaattccaaaggtgaaattaaataacggaattgaaatgccacaattaggttatggagttttccaaattccagatgctaatgaagcagaaaaagcggtgaaaaatgctttggacgtggggtatcgcttaattgatacggcaacggcttaccaaaatgaaacggcagtcggcaaagcaattaaagaaagtggtattaaccgtgaagacatatttgtcacttcaaaattatgggtatcagattttacctacgaacgggctaaaaaagcaattgatgcctcattgcaacgtttagggacggattatttagacttataccttttacatcagccctatggtgacgtgatgggagcatggcgagccatgcaagaggcttatcgtgccggtaaaattcgggcgatcggggtttctaatttctacggggatcagctaaaaaacctagaattaacgatggaagtaaagccagccgttaatcaaattgaagtaaatccttggtatcaacaagtgaaggaagttgcggttaatcaacgtgaagatgttcgggtagaagcgtgggccccatttgcagaaggtaagcatgatatatttaaaaatgagcttatccagcaaattgctgaaaaacatcataaaacggtgggtcaaataattttacgttggttactacagcggaacattacggtgattcctaagagtgtccaccgcgtgcgtatggaagagaatattgcggtttttgattttgagttagacgatgcagatatgaatttaatgagcaccttaaatcggcatgaaagccagttttttgatcaccgtgatccggtaaccattgaacaaatctttgggaaaagtttgaaacaattacgataattagaggagtggtgtaattatgacgaatacaaataaaattaaattaaatgatggtaatgaaattcctgcaattggatttggtacttttcaaattcccaacgatgggaccacttatcaagccgtaaataaagctttagcggcaggataccgacatgttgatacagcagtggcttattttaatgaacaagaagttggacgagctattaaagatagcggcattccgcgcgaacaaatttgggtaactagtaagttgtggctacaagattatggatacgaatccgccaaaaaggctattgatttgtcgttgcaaaagctgggattagactatatcgacctttatttaattcaccagccttacggagacgttcctggagcttggcgagcgatggaagcagctaaaaaagcagggaaaatccgttcgattggagtttccaacatgacgccgaaaatttggcaacattttgtacctcaatttgagacaatgccagcggttaaccaagtggaatttaacccgtattttcaacaaaaagaattacgaaaaattttagaggctaataacgtaaaattagaagcatgggctccattagggcaaggcaacgcaaagttactaaatgaaccggtcatcgttaaattggcggaaaagtatcaaaaaaatgctggacaaattattttacgcttcgaaaatcaagaagggataattgtttttccaaaatcagttcacgatgaacggattaaaagtaatttggatatttttgattttacattaacggaagaagaaatgactgcaattcgcgcgttagatacgaaaaaaggtatgcatgatccggatgctccaggggtaaaggaaatgctgctgtcagcttttgacgtgcacgctgatcattaaaactccacgtaccaaaaaacttttcaagagttttctattcttgaaaagcttttttattttttagcccttaaggccgtgatatcaaacattagtttacaaaaatcaaataaccaaggccaaacaattattttcgcttataaaccaaaacggtaattggcgcaaaaacggcaacaatgccaattcccgcgcataaaactatccaagcctcccgcggccagtatcccgcatttaacatggcacgattggcgctaatcacgtgggataccgggtttatcgttactaaaattcgcatgaagtggggcaaggatttaaccggtacaaaggcgtttgaaaggaatactaatactaacatggtcattaatgacacactttcaactaacgtaggacttttagcaaccagtccataaagggcaaatatccagcttaaggcccagcctaaaaatatgtccaaaaaaataaccatgattagccatcctaacccagcttccggatgccgtcccatcaaataaccggtcgttaaggctgcggtcgctgcgacggctaaccgtaaaatgtcagcaaagagctggccggcaaggggagcaacttgtggaatcggtaatgatttaagacggtcgtaaatgccagaatggatgtcagtactaatctgggtggctgaaccggaagctgcggaaattaaggactgcatcagaattccaggaactaaaatctttaaataagaacttacgctaccataaatggccccgctaaatagatacccgaaaagcaacataaacagggcgggttgaacgaccacgtcaagcagttcatcgggattgtgcagcgtttttaacaaattacggtaagtcatggtaccggtgcttgcaataatatttgtttttcgagtagttgtgttaaacattgctaaatcctcctaataagttagtttttaccgaccgtcatggcaaagaagacgtcgtctagcgatggtttttcaacagctagcgtagttatttcgatgttagaagcacgaagacggttaagaatatcggctaagccattcacgtctcggagcggcgccgtgatttcattaccagcttggtgaaccttttcttgcgtaattgcagtgacgattcggcaggcttgctgggcttgaagcttgtttttcaccgctaggcgcaacttttccccgccaatttgagcctttaactcatcgggagttcctaatccgaccagtttgccatggtcaattaccgcgatgtgatcagctaatgcgtcggcttcttcaagatactgggtggttaagacgatcgtcgatcccgaagcaaccaacttgcggatggtatcccacatctgggaacgggtgcgagggtccagcccggtggtgggttcatccaagaaaatgatttggggacgggcaatcaaactaactgctaaatctaagcgccggcgcatgccaccagaaaaggcagcaattgctttatccgcggaatttactaatgaaaattcttcaagcagttcggtagttcgctgcttagcttgctggtgagaaagtccgttcaaacgagcaaagaacgttaaattttcccgcgcagataaatcttcgtcaatcgaagcatattgaccagtcaaaccaaaaaaggttcgaacggtctgaggttccgatcgaacgtcgtgttccatgattctgagtgaaccgctagtaggttttaataaggtagttaacatccgtagaatagtggttttcccagctccattagggccaagtaaggcaaacacttctccgcatttgacgttaaaggaaacttgttttaccgcattctggttgccgtacattttattcaaattgttaatttcaattgcatatttgaggttgatgataaaccctcccttaatgtgttgggtgatgttcaggggccctgacgaaaaatattataagggcacctgattaaatagtcaaagggcctgattatttagttttaatctgtcaaacggcttgatataatagggctatataagtgagagatgggtgagttatgttggataatctagtaaaaaaacaccaattagcggctaaattatttgaatttacggcattacaaaatatggctgacgaacaggcagaacgccatttgccagtatttaagggacaaaataaaattttagtggccttaagcgagggcgataatatctcacaaaaagaactatcgcagcgattgggaattagtgtgcagtcaattgcagaattcattgccaaattactaaaaaaaggctacgttaccaaacaaaagtcgcccactgatggccgtgtacaactcatcaaattaaccgaaaaaggcaaaaaagaagcaaagaagagtttgttttatattcctgaatatttggattatttaaatgacgacgaacgagctcaactagcagcaatccttgataaaatgaataacggaattcgagaggaccttaagctgcacgggattcagaatatcggaaataggattcggtttagtcaattgaagcgccatattgatgaggacttgaaataactagaaacggacgaaaataagtgaaaaactcataattgttgaaagcaacacttcaatgattatgagttttttcagtggcgggaagctaaaataaattgctaaacaaaaaagagccgaatccaaaattcagctctccattcgttaaccaagtctttacctgcgagacatttctcccagaaaagtttggtacttatcgttaatttatgtaaccgttaatggatccgaacggacttgaaccgtcgaccccctgcatgcgaagcagatgctctcccaactgagctacggaccccttacataaatactatagcacttttctgcggaaaattgatatagtatttatgaaagaaagtaaatttttatcgcagaagaatgattttttaaggaaagataaggagcctcaaaagatgaagagaagcactaaatacgtgttggccggactcggtgcggcactagtcggcgtgaccgctggaatgggaatcggtggttatgcaagtttcttagtaggcattaaaaataccgaaaaagcgaaaaaacgggcgattgaacgttcggaaagtgaagataatgacgccttaaatttggcgtggttcaaccagcagcatccggaaacggtacaaatgcttagcgaagatggactgcaattaaaagcttccttcattcgccaaccgcaacccaccaaacacacggtgatcatggcgcacggataccatcacgcccgtcggcaaatgattccttacgcgaagattttttatgaactgggttataacgtgttgatgccggacgcccgcagtcatggtgaaagtgaaggaaatctaatcggctttggttggttagaccggcgcgattacgtgcgttgggtgcaacgtgcggtaatgttaactaatgctgatgaaaagattgtcttgatggggatcagcatgggagcggccacggtaattgcggctgctggagaacctgacattgcatctaacatggtggcggtgattgaggacagtagtttcaaccggcttgatcaacagttccggcaccgcctcaagcgttactaccacttaccgcctcgggagctagcgctaattgctagtctattaacggaaaaagaggccggatattcatttaaggaagccgacatcgaagcccaaatcaaaaaggttcgggtaccgattatgtttatccatggcgaagcggaccggtttgtgccaattgaaatgttggacgacctagtggaggctgcccaagtaccaagttgggtatatctggtcaaccaagctgaccatgtgcaagccttgaaggctgatccaaagcgttatcgtgaagaggtggcgcacttcttggagaagtttgtgaagtaatggtgagcaagcagatgaaatactactttattatcaataaatgggcgggagcccgccattccgctgaaacttggcaaaaaatgcaccatttactggtccaaaaccaggttgagtttgatagtgtggttaccgaatatccccggcatgccactgaattagcacaacaatttgccaccagtcatcggaaggggtggataattgtcgcgtttggcggggatggcaccctcatggaagttcttgaaggcgtccagcgtgttgatgcaacgattccgttgggatacattccggtgggatcaggaaatgattttgcccgggccgtgggtttatgccgcgacccttatttggcgttacaacagttgatccaaacgacccagccgaccgttttagatgttggagcataccaagaccgcaaggagccggtggtccactactttagtaacaacgtgggaattgggtttgacgccagtgtcgtttaccaagccaaccaaggacaaaaaatcaagttaagcaaatggcacttagaatcgaccgcgtacatttccgcgttgttgaaaacgctggttaaacaaaagggctttccaatgagtgtgacgatcgacgggaaaacccgacaatttaaaaatgcctttttggtttcaattacgaacatcaaatattttggtggcggggtgggaattgctccgcaggctcggttagatgatggcaaattagacgtggtgatcacggaaaaattaacgttactgcgatttatccgcctttttgccaagctgttgaaggacggttcccatttagcaatgcccgacgtgttctttgcgacgggacgggaagttctggtgcattcctttgctccggaacatggtcaggttaatggtgaagatttaccttaccaaccttttgatttaaaaatttggacggtcaaacagtccttttggttcacgttgcaaactaaataaattgttccacgtgaaaagctgttggataaggtggatattttagacagttgaacctgctaaaatgaatcgaaaaagtactaaacttaaagcttagatgggtaaattttgaatttttagcaatttgaaagccgtaatggggtctgattttgtgctttatccgatagattttctttaaatttctgattttagtcattttaattaaaaaattgagacactatacaatgtttaaagtgttaacataataatcgtagttaagagctacgcatttggcatggtagaaaaaatgaaacttctaggttttaaatttagaaacttcataccccattttctattaaacaactgcctcacattgagattattgatatctttctttatttttttgctagcacacctggagccggtctgggtgtgttttttgtgttttggttaagctgagatgattcagttgtcaaagtcaaaggaagctgttagaatattaatgtaaagttagcttacaaaaagtaagtccaactttcggttagctagcgaccttataaaaggagacgttcataatgagtaatcaagcaaacttaactaacgaagaaatttttgatgcaattaaaactggtaagaagatgctcttctttaccgccggatggtgcccagattgcgcgttcatcaaaccagcaatgcctgaaatcatgaagaaatacgaccaatacgattggatcacggttgaccgtgacgacaacttggaagtagctcaacactttggcattatgggaattcctagtttcatcgcgttagaagatggcaaggaattggcacgctttggaaaaggcgaacgccacaccccagcagaagttgaagagttcattcaaagcattgcttagtacttttaaagatgaatatgcgggcctaaaagagcaatcttttaggcccgttttattttggaccaatagttcccgcgtcttaacgtctcttttgggataaaatgcttctctagtgtactaaaaactgaacataccaaaaatgtcagctatagtgaggtagcgcaatgactctaaatcaactggaagattttttgttttggctagcaattttaatggcggttttaacggtggttattattggagtttacttttggaaaacgaggtatcggggcggcaattatttgcgtgatccgcacattccgttacggaattttatccagaagcaagttgatcggcacggccaaattacgggttacgaatgcttattgcgtacccaggacgccgcagggcaatggacgttgccgcaagattttaattctttaccgttacgacgtgtgatcgatttattagaagacacctttgtttccctgccaacggagccggtcaccctgtccatcaaactaacttaccaacaaattattagtcgggactttgaatacttcattcggtgggccatcacgaaaattgaaccgatgaatttggcggtagaaatctcgatcaaagccatggaaaaacgggtgaaccggcgtttattaaggcaacaaatccaaatggggcgaaattacgggatgcaattttccgttaataacgtgggttcggaactaaatgatttaaaaagtattgaatggctcttacctgaaattgatattttgaaggcttcgatgcggagttttcgtaaagaggacccgcatgaatggcttgatttaaaccttcagttttggaatcgtttggcacgcaagaaccatattaaattggttttagtagggattgaaaatgctacggatcaagcgttagcagaacaattacaaattgatgcccggcaaggctacctttttggcaagcccgaggacgttcatcgaggtgcagaaaaatgaaagataaaaggcaacaattatataccgacccgtattttgaaaaaggacactgggggctgaagattcggcaaactttagtcgcccttttgggatggattggggtaatcgttccagtaaccatcacggcaactgccttatgggcacaatctgatccacggatttcccatctatgggcctatccagaagggatttttgagattaagttcttagcggcagttttgctatttgcctttgcgatggcgggactatttgcggttagcatgaccattatccaaaaccggcggcgggatcgcttggccgaacagtggccgacgtttaacccaattaaccagcgaaaacgggaatcacgtttagagaaattcatgaccgaccgttttggagatgaagagtttcgcgaaaacgtaaaatactatgaagtagagcccgaacaaaatctggatacggacgaaattcatcatttatatcaggaagccaacttggatgatttaaataaggattaggggcatggcgccgattgtatttaacaatctgtttaaaggtagctttttagctactgcggctaattttgtactattaattttatgcttgtaccccgtagtgggggcgttcttttggtttaccggctcgttatcttaccgatttttaaaagctaacaaacgcgacgataattggcgaaatttgcctgcagaagagcagccgatggtaacaatcatgatccccgcccataacgaagaggtaatgattgaagaaacgattacctacctatttgaagaaattaactatgataattttgaagtattagtgatggacgacggatctacggatcataccgctgcgattttggcccggctccgggagcgttatccaaaattgcgcaccattaaaattaagaaaaataaggggaaggctcacgctttcaatatcgggatgtactttgctaagggcgaatacattttgagtaacgatgccgacaccattcccgagcccgatgcgctgatgaagtatatgaacttttttctgagtgatcgcgacatcaacacgtctgcggtaaccgcaaacatggacgtccaaaatcgaactaaaatcattggtaaagcccaaaccgtagaattttcaagcatcgtgggagtaatcaaacgcagccaaaccgcggttaacgattcaatgtacgcttacagtggcgccaacaccatgtataagaaggactttttaattgacgtgggtggttttcgccaaaatcgggcgacggaggacattagcatcgcctgggaccaccagatgattggcgcggtgccccggtttgcgcccaacattgtgtttcacatgaacgtgccagaatcgatccgtgatctttatcggcaacgtaagcgctgggcacagggcgggacggaagtctggttaacgaacatcaagaaattcgtccggcaccccattaaacaccgttaccaaatgtcaatgtttatcgattcaaccctttcgattatctggtcgtttttcttcgtgattacggcaattattttcgcaatcaccatgggcggcgcgtatctaactgggcattacgacaccgttttccgtggttttatgatggcctttatctttattgcctttgaaatcattgccggcttttttcagctattggcggccttgttactagatcatcacgcggccaagcttaagtacatcatctttgctccgttgtacatgcttttcttttggatgattaaccccattacggtggtaaccacgtttatcccagccttaaaaaccatctttggattgggatctgggacttgggtaagtcccgaacgcaaatctttacagaataaaaaataagttggggcatgttttgcgttttattcgcgaaacatgttttttgtttgccaaaaaattgtacaaaatcaatgggacggtgcaaaataaaatgtaagggatttcatcaatttaacaagggagacgagcacatgacaaaattacctaaaaatttcttgtggggtggcgcagtagctgctcatcaactagaaggagcttggcaagcggatggaaaaggcgttagcgttgcagacgtaatgactgccggtactaaagatcacccgcgggaaatcactgacggagtggttccgggcaagaactatcccaatcatgaggggattgatttttaccaccgctacaaagacgacgtgaagttatttgcagaattggggattaaggcgtttcggacctcaattgcctggacgagaattttcccgaatggcgacgatccggagcctaacgaagccggtctgcaattttatgacaacttgtttgatgaatgtctgaagtatggcattgagccggtggttacgctggcacattttgaaatgccgtatcatttagtggaaaagtacaacggttttgcggatcgccgggtgattgacctgttcgttcggttcgcggaagtttgttttaaacgctatcgtagcaaggttaagtattggatgacctttaacgaaattaacaaccaaacgatgtacaacaacgattttttgatggcaaccaattcgggactaatttttaaggacggggaaaatcgggaagcggcaatgtaccaggcagcccactacgagttagtagcgagcgcccgtgccgtgaaactaggtcatgaaatcaatcccgatttccaaattggttgcatgatcaatttcacaccgctatacccattgaattctgcgccaaataacgtcatgcttgcggaacgactaatgcaacgtcgctactggttctctgacgtacacgtaaatggcgtttatccggcgaatattgaggcgtacctccaacggaagggctatcgtgcagacattaccgaagaagatcggcagctcttaaaggaaggaactgtggattacgttggatttagttattacagttcttatacggttgctcttccggcagggatggatttagatgccgacgagttgccattggaaaagatcgtggtggataatccgcacgttaaaactagtgactggggctggtcgattgatccggttggattacgttattcattgaactggttgacggatcgctatcatttaccactattcattgtagaaaatgggttgggcgcttatgacaaggtaacggaagacggccagatccacgatccgtaccgcgtggcctacttacgggcacatattgaagaaatggagaaggcggttgaactcgacggggtggacttaatgggatatacgccgtgggggttcatcgaccttgtttcagcttccacaggacaaatgtcgaagcgctacggatttatatacgttgataaagacgatgaaggaaacggaacgctaaaccggtctaaaaaggattcgtttgcgtggtatcaaaaggttatccaatctaatggagaagacttggcttaattaggtggttaattatcaatcctgtgagctaaatccgttcagtcactctctgattgtgctaaaatagcattaggaagggcttgcaccaagaacggagggcgatatttatgttgtattatgaccaacacgtacacaccgatttttcgtttgattcggacgaaaagatggaaaattacctaaaagtttccggagatgatttcgtttcaacggaacatttggaatttaataatcttgacgcggataaaaaagatagcattccggactataccggatacgttactgaaattgaacgattgaagaaggctactggtaaacgaatctataagggcgtcgagattggcgtttcagccggtcaaattgatcgcattaaggattacatggcacatcatgcgttcgacttgcgcttgttaagcttccatcaaaatggcgagatggatttccaagatgaacaggttgcccatctcgatccgttgaaggtcacgcaggaatactaccaaatgatgtggcaaggaattaacgaatatcatgacgcggatgttttggcgcattttgattacggggttcggcgtttgaacttaacttcgggacagtttgctacgacggcaggcgtcctgcttacgaagatttttaaagtagcaattgaaaataacatggcgtttgagttgaacaccaagagtatgtataagtatcgcaatattggtttgtatgattacgctattgagatttacaaacaactcggtggcaagcgttacacaattggctcagacgcacatgacgttactaattacgaaaaccattttcaagatgcattagcaatgttgaaagctcacgacattcatcacgtcaacgtctttcggcaaggtgccatgaccgtaataccgattgataatgttccagaagatttgtaaaaacttgaataaaggaaagtgtgttgttccaaataggttgggatggcgcactttttgtttgcgtaggaaacgacgatagcaaagcaatggtaataaaatgaaaccgctccgtaatctttttgcacaaaaattaaaataaatgtcataaaagtgttgacgggtgccggagatgagtgtatagtatatcggccgaaatcgaatccgaaccggacgttgacttcgataccgaatcagagccggaagtcgatactgagtccgaaccgggagtcgagagtgattccgaaccagacgttgacttcgataccgaatcagagccagaggtcgatactgagtccgaaccggaagtcgagattgattccgaaccggacgtcgacttcgaaattgagtcggaaccagatgctgagaccgagtcggaaccagaggtcgataccgaatcagaaccggaagtcgagatcgattcagaaccagacgttgacttcgagacagaatcagagccggagcccgaaactgaatctgagccagaagtcgagatcgattcagaaccagacgttgacttcgaaattgagtcagaaccggaacccgaaactgaatctgagccagaagttgagatcgattcggaaccagatgttgacttcgagattgaatcagaaccggagcccgaaactgagtcggagcctgacgttgacttcgaaattgagtcagaaccggatgttgaaattgattcagaaccggacgttgacttcgataccgaatcagagccggaagtcgatactgagtccgaaccggacgtcgagagtgattcagaaccagacgttgacttcgaaattgagtcggatccagatgctgagatcgagtcggatccagaggtcgagaccgaatcagaaccggaagtcgagatcgattcagaaccagacgttgacttcgagattgaatcagaaccggagcccgaaactgattcggaaccagaagtcgattttgaaattgagtcggatccagatgctgagatcgagtcggatccagaggtcgagaccgaatcagaaccggaagtcgagatcgattcggaaccagacgttgacttcgaaattgagtcagagccggagcctgaaactgagtcggaaccagaggtggagattgattcggaaccagaagtcgatttcgaaattgagtcggaaccagatgctgagatcgagtcggaaccagaagttgacttagaaatcgagtcagagtcagaggctgagatcgagttaaagccagacgtggacttcgagaccgaatcagaaccggatgccgactcggaatcagatgttgacgctgcttcagaatcggatatcgatgatgactcggaatctgacatcgatgctgactcagagcccgaatcatcaaccaccgttaaagttgcatctcgttcaacgcttgcgagacttttcggatcaaaatattctaaatgtaccgtgtaagttcccgctacgtcccaattcacatcatcaaaattagcttggacatctgcaggatccccagggcttccgtctgaattcgttactgaaacaacaaaatctgcggccgttaaatgtgggtcccctacatgagtttcttcgtcgtgaaccactaagtcaattttattttcttgatgaaggtatacataccgcaatacaatattaccttcatctttatcatagtgagaccccctatttattgcatcaataaattcttgagcgctatgaaatgggccaaaatatttaacaagctccatccattgacttaatgacatttctacattttctatatataaagttgactgatcaagatctaaaacataattaggatcattaaattctggaggagttagatctaattgttcccctgaatgatgatcagattcttccggatctaacaagttattgccgtcttcatcagtatgtaaaaccgtctgatgaaagacatcatttttagtatccgttacttctttagacgtactatgcttattttttatattattattactggcactttgactttctgaaattgataatgagacgcttatagaattttgatatttagcttcagtactatttgaattatcttttttttccaatgaactgcttttagaatcactattttcagaattgctatttagcacttttgatttactgtctgtttggctaatatccttgctatccactctcgaattttttgtagtgttcgcctttgctgagttattcgcacaggtctgacttgtagatgccgaaccttctttactgtttgggctgactgctgttgagtctttcatctctgattttggaataaccgcacttgttttcgctgctaacactgcgtcttcgttcttgaaattcttagttattgcccttttctcggcagcgcttacagtattagttgaacccgcccctagaagaccagtaactaatcctatcccggcaaatagccattgcttgccgtctttgtacattttataacgctttttttcgttgacattccatagtttatttctggacatcagtttctccttatatatatatatcaaacgcacaattacctacttacaagtaaaaaattattattattcatttttttgctaataaagcgcatccaaataaaatatcacttcaacacttaataaccgagttaatcattccacacatacactatataccttcttcagtgtttaagatacctttgttcagcattctttcgtgcaattactgcatccgtaaagtcttcgaatgcctcgtttagtttgaactctcctttatacatcatcctcgctcgccaacgttgcacacttttatcaaaagaaactccaactattccacttttatttcgtttgcccacgtaaatcattttcaccgggttaccaagcttatctttaagacctttagggtttccaataaaccttttagtgttgcgattttgacgaattcgttgtgccgaggcttcccttcttaaacaaccacaacttcgaacaatcccgtgcctaagtgaataactatccacctcgacggtatctccacatttacatttacataaccaaatcaagtttttattagcccctcgccgtgaaacggtctctagaactttgagccggccaaaacttttaccggttaaatcgattttccttgaaatattcagccactcctccactaaaaatttgataaactagctccttagggtaaaccctaaaaagacattgccttcattttttaacgtgtattattaatactttatctgacgctcattttacgtttgattttgtttaaaaaagtggattataaacgtgaattttgtattctttggaaaacttgataccagttaaaccggtgaattaagcctacttttaaagtttatccgatagataaataattacgtaaaaggggtatacaactcgttattaatagggtaaacttttctacatggtgtaactcgtaggcgttgctaatggatatgcttacgctcaatttatctgtctttttagggtttaccctaaaaagacatttttgccgtaaaatcgccttcttttttgattttgtaaaaaaatatacaatctacgtaaaacatagggtattatttacgaaattattatttgaccatagaaaaaagctcaggccatgcaagtatgcatggtctgagctttaataatttctatattcataaagggagtgtttcttaattacactcattattgtctaacatttgctttaaattcagcagaattgaccaaacactttaaaatttttaattttagctatgaatgaataaaccaaaattactaacctagccaacgtatttctcaattgccttatcaatattttcccgtacttgggtaactcgatccatttcgctttcttcgacgtgtggtaatggataacgggcgcggcccacggcaacccctctttgcgccagaattaacttcattacgtcgtaaagatttcctttaaatgaagttaattgtgaaattagatcattgacgcataactgaatttccaacgccttatctaattcgccttctcgaacacagcggtcagcttctaaaagtaactctggataaacgccgtacgttccgccaattccagcatctgcgcccattacccgaccgccaacgaactgttcatcagggccgttaaaaatgatattttcctttggagtacgcaatttccacatattgatgtccattaccggcatggatgaattcttaaccccaatcacctgttccttagccatcatcttcttaaatagtttctcagacaatgcgtatccagttgtttgaggaatgttataaatgatgaaatcaaggttggttgcctccataatacttgtccagtatgcttcgattgcggcctctggcagtacaaagtagattggtggaatagctgccaacgcatccacgcccaattgttccgcgtgtttagctaattcaatgctatcccgagttgatggtgccgcaacgtgggctataattgtcatttgtccgccgactgctttcattacgttttccaaaactagcttccgttcttccaccgtttggtaaatacattctcccgaagatccgccgacgtagagtcccttcactcccttggctaaataatacttggcaagcttttgcacccgttccggactaacattacctccgtcatcgtaacatgcgtaaaatgcagggataattcctttatatttatcaagattttttgtcatttcaattactccttttaatttttgagattaactttttgatcaatcgttttaaacgtcaacccggtaatgtcatgttgatgacccggtttgaggaaactaaatatatatcctaaaatcatcgcacctaggaagcccactacactaacaaaaagggcgttgattccgtgagtttggataaagtagcagattgccgtagtgacgatcatgccgagggttgctccaaagccgtttgcccgttgactgacaatacctagagcaaagattccggcaatcggtactccaaagagtccaaacaacgaaaggtacgtatcgatcatgtccgaactgtgtaacttaatcaacactagcgtcactagcaagccaaaaattccgcaaatcaagatacttagccgtgtaatccgcatactcatccggtcgctcttgtccttcatgaaccgcttttgaatatcagttaccaaacaagccgcggtactatttaaactcgaagcaatcgtagcttgcgaagccgcaaagatggccgcaataatcaacccggcaactcccgctggaatttcagttaatacaaaatatggcaccaatgcggaagtgttaaatccggttggtaaactaccaccgtgttggtaaaaactgtaaattacagtccccatcccgtaaaatagcggaatggtaattaatgacaacagtgcgttggtccaaattgacttagcaatgtgcttattgtcagtcgaagtggtgtaccgttgaactacgtcttgactggccgtgtattggtacaaagtgttgaaaatctgtcctaagaggatgattggcaccgttgacttagtaacgctccatacaaaatcagccttagttagaattttccctttattgacggcatcttgcgcaacggtttgcaatccgccgtgggttccgtgaaccgcaaagaaaataattaaaaccgcgcctactaataggaggattccttgaattacgtcgctccaaattaccccttccattccgccatggtatgtataaatgatacacaggatggtgattaaagaagcgattaggtacgggttaatgttgataatggattgcagtgccacggtcggcaaataaattacaattgcaatccgcccaatgtgaaataacacaaacaaaatgctgctaaacacccgtaaaaacgggttaaaccgaaactccaaatattcataagccgtggtcactcgcaactttgaaaagaatggaatgtagtacttaattaataccggggtaatcaaaaaaatggctaaatttccaaaggcataagcccagttggtcaaaaacgatttttctggagttgacatgtaggtgatcgcacttaaagttgtcgcgaaaatactaaatccgaccgcccatgccggtacgttactagtactagccttaaagaactcttccgaattttttgaactcttcttactgaaacttaaaccaattactaacataatgattaaataagcaattaaaaccagccaatttaaaacaccgaatccttgtttaaccatattacgcagtacctactttctacgaattccaaattaaatgattttcacgtagtttaagtagcggcatttatcagccagtaagcctgattccttcagaattaacgaccaatcttttcaaaaattgcaataaaaaatgccacaaaaactcgcactacatgatgtggtagtgtgaaacctttgcggcagttgaattcgcattaataactattacagatagagattataaactgttccctgttaattgtaaaccctttcaaagaattaaatttactttttgaatttcttcgtctaattcttcatcagtagcaactccgtattccaaaaataccggcacttcagaatttaaagcttgcaccatggattgccaattagttgctccctcacccagacggaccgtggttaaatcggcaatatctttcaaatgaaacacggtaatccacttctttaaagaatcaaaagcactttgcggatcttcttttatccaataccagtttcccgagtcaaacgtataacctaactcaggaaccaacgccaacaatttaatcaagttatctttaaaaagttctaattgtccatcctggtttggttgattttccaccgttaccactccagaatacgcgcggagtgctttttgcaattttgctagacttgaagcgggtgtattttggcagtcgcccaaactaatctttaatccttgaatttggaattcgtttgccatgactaaatagtcaaaaatattttcgtttaatcgtccttctgtaaataaggcttcgggaatcgaatagtaaaattgccaatcgttttccttacacaatcgctgaattgtagctaactctagatcacggtgatcttcttgaaaaaattcaccccggacttcaattgcggcaattggctttccaattaactgttttaggcattcgctttgactacgtccattttcaagctggtttaaaaatactgcggtattaatcgatacttttttcatttaccttctccttatttttcttcaagaacggcacaattgctccaattaattgcgcttggttaccttgttgcgcaatttttagcgtggttcggttaaaatctgggggtaataatgcaggtaattgcttgttaaacagatcaatcaaatattgaccctgtgcagaaaccgccccgccaattatgatgtagtccggatcaaataaaataaccacttcagcgattcccctagccacttcgttagcccaccgttcaataattgattcgtaagttgcttgaccctgtttagctttttcaaaggcatcaattaccgttacacccttatcggctagttggcgttccaaaactaacgttgaagcccgttgttcataattggtattcgtttgcggatcaaataacgtatatccaactgaattgccctgtccatgcgctccactgataattttcccattacgataatgcgctccaccgattccagtacctaacgccatgcagtacacatcttgattcactaattgtcccgtaaaaacctcgcctagtaaagccgcgtcgacatcattaactacgctgaccggtaagttagcctgcgcagtcaaactagttttaatgggcgtaccaatataatccggaatggttggacctgcgtattgaatactgccgtcccggcccacaattcccgccgtactgaccccaattccagcaagttcgaacctttcttgaatagtttgacttatctgcagcaaggtttttaaaatatgtccgtttcgattttgttctgtattaaccttccctatatccgtaaaatttaattgttcatcaattaccgcgtatttgatggtggtgccaccaacgtcaaacgccaaaaactttttactcatctcgggttcctccaatttaaccagcattcatgataacgatttcatattaccatccgtttattattttcacaatctaaaaaacgaaaatattttttgttaccgtcacaacaacgttttttcgccaaaatgaaaataattaccggatttggttattgcaatattttttaactcgagttatatttactgcggtggttgaattagcaattaactattacaaattaatttttatttcagaccctagattaagtagcgttttttttaagaaatcaaatttgataaaagtgaagtgtcagtatatgaaaaatagatttttagacgctgtcaaaggacagttaatcgtttcttgtcaggctttaccagatgaaccgctccacagttcctttatcatggctcggatggcacgggcggctaaaatggccggcgcagctggtattagagcaaattcggtagtagatattcaagcaatccaagacgaaactggtttaccaatgatcggaatcgctaaaaccgactacccggattctccagtattcatcacccccaccatgaaagaaatgcgggcagttgcagctaccggcgttgaagtagtggcttgtcaagttacgggacaacctcgtccgcacgacgaaaagattgctgacatcgtcaagcaatttcgagctgaatttcccgacacccttttgatggccgatactgacattatggaaaatgctctcatggcagatgaattaggttttgacattattggtaccacgatgcgcggttacacccccgcttcaaaaggattaaacattgccgacgatgactttgcttatctcaaagaactcttgcaaaaagttcaccatccggtggttgctgaaggaaaaattgatactccagcaaagctgaaacggtgcattgaattaggttgtcattcagtagtggttggtggcgcaattacgcgaccgctcgaaattgcaagtcggtttattgacgcaatcaaataattaccaaaacttgaaacgtggctaaaatttaggcgaaagtgacccttaactaaacgttccggttatttttaaatggctgggaaaaaaataaagaaatgcttttcaaggatgaaaaaattgttttgacttcaatagcggcaaaatacgtaccaaaagctaaaaggcttcccgagaacccacaattcttaggaagtcttttttagtttcccgactactttcgtcattcccggataaaagcgtataattaaggctattagcatagaccaatgaggaggttctcaatgaatattcttgaggcggtagaacaaaaatatccttcgttatcccggcaagagcgtaaaattgcgttaaaagtaatccagcacccttcccaggtaaaaaaaatgagcatcggcattctcgccaaaaaagctgaagtcagtaccgcgacggtgacgcggttcgttaaaaaaatgggttgccaagattttagtgaatttaaattaggcttggcagaagcaacttctacaattactgaggacgtcggcaatgccccgctacctgatcaggtaactaatttttataaccaaatgatcaccggaacctggaaaaaaattaaccaaactgctttagacgaagccgtgcaattaatcaaaaacgccccccgaatttttgtgttcggcctaggtagctcgggttacaacgcccaagaactatcccagcggctcctgcgcatggggatcaacgcctttgccccagccgatagtcatacgatgtacatcaccagcagtattatgcaaagtgacgatttagtaatcgtgctttcagtttctggaaactcagcggaagtcaacgaagctactaagctagctaaagaacaccagcttaaagttattgcgattactgcttttgatgacagccccctagctacgatgagcgattgcaaactatttgtccagtacagcgattttgtggataacacccgctttattaactcccaattagggattgtctacgtaattgacgtcttgtcgaccatgctgctacacgacccagactacaagcaacattaccaacaaaccgtagaagcaattttaagtcgcaaattgcgttaattaattcataaccacaaaaaaggtaaggaattgaattcgtaaatgaattctagttccttacctttttaaatttcagctaattttaattttggctaaccgtcatacttcggtctacgcgggaacgaccggtcgtataatcaaaccgcactcccggttgaacgttccaaatgaaaacgttgaagttaaggctaccgtccgtcgaaattgcttccgaatggtagccgattggcatcaaatcgttgcctttaaataccgtagaaacccggtaaatcacccgtttgtttttcgccaaagcatcgcgtacccgttcttcaaaaatctgcatagtttgttggttactgaaggcggtctgcgtagctaagttcttggggttgtctaaggagcctaatttccgaggattgaagttaccattttggtcaaacttgccagttaccgaataggctaataagtggccccggttttgaatttcaacgctacgtccgttgattcgaacccgtttttgatgccaaccggtaggattccaagtttggctagtccgggtacttgattttactaaattagcccggcttaggtatccggttgcctgagtcgtccggttcaaacgatccaaattaccataatcaatccggttggtcttccaatctttcgggtttaacgtactccggttatggttgacatatatgtaagctggatcccctgatttaaacgttaattgcgacaactggctgtcagtcacgcttttcgtggtctgggtattttggggcattacttggttaagcaagttgttcgttacttgatgaacgtcgttaccttttagaaacatccccaaaatggccacaattaaaattaaccaccagttattagaacttcttcttttctttcgtttactcataattcccccattaattttaaaaacaaaaaaagttggggttggacaccttaatcttccagcctcaacttattttattaaattactttttggattactttctgagcttcaaggccagctcaatcgaacgatccaccagtactgattgggaatcaactactggataagaatggtcgtgcgccatttcttgagcgtaagaaagttccgtgcaacctaagataactacttgggcgccccgttcttccgtcattaaccgtaaaatctggtagaacagttgggcatccactttattttgggccttaatatcttcaaaaattaacttgcttgttaagtcttgaatttcaggagttggcttaacaacttcgtagccttccgcaattaattcccgatcgtaaattccgtccgtcgtggttcccggggtgccaataatgccaatccgtttagcagctggaaactcttttttaatttgcttaaccgtttcacgcggcatgtgcacgattggaatttcagtcgccttttgcaaatcatcataaaaataatgagccgtgttgcaagcaatcacaaaaaaggctggatttaaccggctctgctgttgaatatcctccaacaagtcgggatacgggttgggctgcgaatggtccattaaataagtggagcgatccggaaccgtagcatgattaactaaaatgtagtttaagtaatcttggtcccggtgcgccggcgtgcgggcgttcaacaaccggatgtagctttcggttgcgggcgtgcccattcccccaataattgtgaaaaagtccttcattccacttaccccttgttttctttaaaatactttcggaaattcttgacgtagttatggttcatccaccaaattaaaagactgcgtttaaaattcatgtcttcgtcataaacggcggtaaatccgtattgttcgcggttaaccaaatcaagtgccgcctttttttcttcattatccttagcatatttcttgaagaccttaactggcacacctagccaaagtttccggttttcgatgacgtcgttagcataaaccggcttcatgtctgccaaagtgttgttaacataatcgtcaaccacccaacgggccaaattatatccatttaaggtaacaaagaagctactccgcccttggcgaatgttaatttcaaatagcttgaacttgccatcacggtggtcatacttcatatcaaagtttgcgtacccaacgtagtcaatactttccaagaattttttaacggtgtcgtaaatttcttggttaaattcgggcaaaatggccacgtaattaccaattgcggatggtgccgggtcttctagcaacggatgacctaaacacatcatctttacctggtgattttggtcaacgtaggcgttgagcacccgcatgttactatcgtcccccggaatgaaatcttgcaaaatcaaatcggaagtgtagccattgtcgtaaattttagcaatcacgtcgtctaactcggcttgggactgaatccggaaggctttcttccgcccttcaaaatgaatatccaaccattcaacactgtcggccggtttcaaagccactgggaaaccaaatggtgaagtgaacgtttcaccactttcgtattgggctttcgtgatgaacttggttgccgggtaaggcagattatattgatcacaaattgaataaaaacgttccttattgttcaactgtttcaataggtcgtaatcaatgtatgggcaaacaaaggtctgcgaaagttcttctttatgcttagaaattaattccgcgtaaccatcgcccattcctaataagattactttttcatccgaatcttggtactttttagcaattttccgcattgattcgataaataccggatcttcagaaaaaccaggaataatttcaacgttcacaatgttagtaaaccgggtcggtgctagcgtagcactagcgtaggcctgaacccgtctccccgtgatttcataaaaagcacgggccattccgtaggcgttaaagtcactccctaaaagaattggtgtaaagttgtttactggtctttccattaactgattccccttttcacttcttgtgcaacgcccatatccgttggccaaggcgtgtcaactccccgtactttttggtacggatcttcacccttcccagctagcacgacgatgtcacgagggccgctttctacaattgcttggcggattgcttcgcgccgatccagcacttggtgaacttcgaccgttccaggttcaatatgggccataatttgggcaatgatgtcttgtggatcttcaaatcccggatcatccgtcgttaagtaagctacgtcagcttgttcactaagggcttttccaaagccagctcggcgtgaaattcccttatcaccaggacttccaactaccacgatggcctttccgtcgtgatactggtgtttaacaaatttgagtaacgcccgtaagctcgcgtagttgtgcgcataatcaacgaaaacgacgccgtgtcctggaattgctaaatattccatccgtcctggaattacaatttcacttaacggttttaacgccgcgtcgcggtccgcacccgcaagtgcagccgcaataatggcggccgtcgcattactttggttataatccccagctacatttaagtcgtattctcccgtaattgctaaagccggcttggtggaactggtagccgcaatcgtaaaccgattattaattaaatcatcttccgcatttttgatggtataatccaccccaccattagcaggatctgcactaaataagtaaatctgcttcggatccgtagtagcttttgcagctccatatacgtcctcaaagcgattagtatccgcatcaataatgcaccttttagagttcaccatcaactgtaatttgcagtggaggtaatcttcaaaatctttatgctcattgcgcccaatgtgatccggcgtaatgttgagaaaaattccacaatcgtatttcaaaccataaacccggtcacgtaaatacgcttgtgacgatacttccatgacaaggtacttcatcccattatccacggcctgacgcatatcgtggaataaatccatcgattctggcgtcgttaagtctgacttgaactgatcctccggtcggggacctacaatccggtcaatggttgaaaacagcgccacttgttgcggatactgctggttcaaaattgcgtgggcaaagtacgctgaactagtcttccccttcgttccggtaatcccaatgataaacaagtcattttgcggaaattcgtagtaagtagccgaaagaaccgccatggctctcgtaacgttggttacaatgattgcagtcatgccggttccttcaggatattcgcgttccgctacgtacgtggtggccccagcttctcgagcggctttcaaatatgctggttcaaagtttcccttacaaaagaacatatctccaggtcttacttttcgtgaatcgtaggtaattcctgaattgacagtcgtcgttgatgattcaatttttttcaataggtgatgttccgcaagtacagttcttacggtacctaattctaacttcatctgctcatccccaactaactattcttgcgttttgtgtactaattccacggtcttcgcagtggtatcttctgggaagtaaacttcataccagaggatgaacgtgtaaatcgtgaaaatcttttgcatgctcgatttaccgttaacgtgttcttctaagatgtgcattaatgcttctggtttgaagaacttcttcgcaacgtctgaattaaaggcttcttcgatccgcttacggtacttatcttccttaatccagttggcaattggggatgggaagccaagtttttccttctttgcaacccgttctggtagttcagcttcagctgctcgacgaagagaaaccttggtttcatccttgtgaatccgagtcttaattggcatggttgcggcaaacttagccacttcccggtcaactagcggagtccgaacttcgagcgagttcgccatgctcatccggtcagccttatgcaagatatcaaatggtaaccaagtattgatatcgaagtattgcatttgggtcatttcgtccttaccgcgcacctcgtcaaagatgtgttgggtgtaggcacctgaatcaacgttgagttcaggtttagctaagatttcactacgttcttgttggttaaagacgtagttaacccggtagtagcgttcacttaatggttgtgccccccgcattaagaagcgccgaccgtggaaacgtggtaatcctgaaaccatcttagccaagcccgtccgaataaattgcggaactagtttttgatagcgttcgaaggtgaaagcttctaggtaagtgttgtaaccaccaaagaattcatcggcaccttccccagataaggcaaccttaacgttttcccgggttcccttggaaaggtagaacagttgcattgccgatgggttagatagtggttcatccatgtagtacatgatggttggtaagatatcgaagtaatcgtcgccatccatgtacaacggcgtattcttttggtgaatttccttcgcaaattcggtagagtagctcaattcactgtatttggaatctttaaaccctagcgagaacgattgaattggtttcaatttagcggcttccgctaaaacataacttgaatcaattccgctggaaaggaagcttcccacttctacgtcggcaatcatgtgggcatctaccgaatccttaacaatttgccgaatctttttcgcatcgtcttccaccgtttggttttcgtcaatgtgatcgtaattgaatttgaaataagtgtgcgtttccgtcttgccattcttgtgtaagaagtaagttcctggtagcaacttataaacgttgcggaacatggtttcttttgacggaatgaattcaaaacttaagtgaattggcaacaattcttcgttgaattcctttttaaagtttgggtgatccaaaaaggccttgatttcagaagcccataggaaagcatccccatcatcatagtagtaaaggggtttgatcccaaaatgatcgcgcgcaccaaaaacttcttgcttttcagcatcataaattacaaaagcaaacattccgcggagcttttgtaaaagttcggggccccaagcatcgtaaccatggatcaatacttcggagtctacgtcggttttgaactcataacccaagtcctttagttcttgtcgaaccgtcttgtagttataaatttcgccgttaaaggtcaatactttagttttagtgttattttgcattggttgacgtccgtgggcgaggtcgataattgataaccgccgaaaacccatcgaaacgtgttcatcttgaaaataagcttcatcatccggaccacggtgtttgatccggtccgccattgatttaattgtgtctttattgacattagtttggttaacatacccaacaaatccgcacattttgcaatccccttttattcttcaatctgtctatgtacttatttccctgtttttacatacacttaatttaaaaatgcccgcatatgggcgaaatatcatgttttcatcatattccagtaatatataacattttagcaaaaattgcataccaatactactatcgttaacttttcttaaccgactgcccggctttctccggcactttctttgtcgcttgaatttttagtcaaaaaaataaagtgctttagccagcttctacattgaccaaaacactttaatttaaattattttgcacaaattttgtacatccgtcactttaacacctaccaataaggcttatctatgcccggaacaagattcgaacttgcacatagttgcctatacagcgacctgaacgctgcgcgtctgccaattccgccatccgggctcaacaaattaattttacactaaacaactataaaagtgaataactgatttaaatcaatgagggattatcatttaataagttttaaattattttcaacgtgtatatcattaacagttccaatcacttttcatgtataatacaaataagcaaaaaaataaggtaggtaattgcttatgggggaaatccatcttaactgcattgtccgttgccggtgttccacggacttaaagcagccttttgtggggaaagttatcaaaatggatgacgatgaggccgttgtaacgatccttgaatatgatccttgcgaacgctatgtggcgtacgaaatcaactacactactcgggtaaagccgtgtgatttacgccccgtgtccattaaagtacaccgctcgaagtcaaactaaatttgactcttgcaaaattaaaaagtgaggcccatttcgttctttacgaaatcacctcactttttaacattttatcgggtttattacttttacgagtagtcaccaatcaattaactgttacttatcaactactactaccgtcccgtaagcatgtaccaccaaaaatttaagtgcaccgtttagttccaccacttcactgttatactttaagccaatgatgccatcgccaccactcaactccgcttttttcttaattttctccttggattcgtcaaacaattgatcaaacatgttgtacttatcaatatcttctgaagacagcatcaaactagccgttgcttcaaccacgtctttaattgtgtaaccagcattgatacctgttgtggtaataaacattatggttcctcccgttttttcgcagcttcctttttttgctcttccacaaattttttcattcgtgatttaacttcgattacggtggtagtaatcattgaaaataagaatccaactacccaactaataaccagtggtgcgccacttaaatgaaaaaactcggttgcaacaactaaaattaccgccaccgctaacggcaacgtaattcttaatgacttcatttttttctctccttgcgttgtttaccatcggttagatgcttggaaaagtattgtacataccaagataaaattatcccgacaatcacaatgataattaatttgttcgttcggctcaaatcagataaccaagttaagaccatgattatcgttgacagaatcaacaaaatcaaagaagttcgataatacgtttttttcggcattttaatcctccaaaataaattgatgaatggcttccgcaactccgctagtgaaatcaccttgggtaacgtgcttagccatccggcgagcatccgcagtagcattcgccaccacaactggcaaacctacctgacttagcatggcgatgtcgttgttattatcccctaaagccatgatttcatctttttgaattcctaaccgttttgctaatgctaaggtagcctttcccttgtctacgcccccaaggttaaattctgtatatcgatttgaagaaaaggtggcgttcaaatcaaagtctacctggcctaacacttccttacggattgcttcccgcttttttggatcgtggttcatcgtaataattttaacgatgggttggcccgccaacggttctaacgttttgtacgggtaatcctcaaccttaacgcctcgcccggtcatgtacgcagtatcttcaggatcgggattgtatacgtaaacgtggttcaaagtgtaaatgtgggtagcgtagtctaaccgttgtttgaccacgtcaaaaatttgagttgcctgagttgccgacaatgcgttaacttgaagtactcggcaatctttattttccacaatcgctccgccattataagaaattacgtattcgtccggttgatcgcgcaatcccaattgctctagtaatggctgaactgattgaaatccgcgtcccgtgttaggcacaaattttactcctaatgcagtagcttttttgattgcttgaatattaacctctgaaacgccagtggggcccactaacgtttcgtctaaatcactaacgactaattttatcatagtttatccttcaatccattcgtttactttagacgcataaacatctaaataatattatttttggttttgtagtgccgccttgtcagctaattttagtcggcaaatctaagttagctgagttgtttgaggttggctcttgaatgcttagcctaaacggtctcctgaatccaatctcttccggctaacctaattgcgtaatcaatcgccaagagcgcgattaatccaggtttatgccacctagtcaaaacgggcaaaaagccttagccttctccggttaaccaagcatgaagacgaatctcaaacccagattcatctacctctcaacattcacagcctaaacgggctcctgaacccaatctcttccggctaacctaattacgtgatcaatcgccaagagcgcgattaatcacgcaattctgttagtcctcaaagattacccgggttcactcgccctctccatcatatcccaccttggtagcgcttttcaaacctttctttaatggtcgacggggtttattttttacccggatcaaaaccagcaagcagtttttttatcaaaattcaaggttgttttgccccgaaattctttatacaatatgttgtggctatctggaaatttaggaatatttagtactagatttcggcggcaaaaaacaaaaagaggggcattttatggtgataattacagcaggaatgatcggcgttggtaagactactttgacgggaaaaattgctgaatattacgggacacaggctttttatgaaccggttggcgataatccagttttaccgctctattattcagacccaaaaagttacggatttctactccaaatttactttttgaacaaacgttttcaaatgattaagaaggcgttggctgatgacaataacgtcttggatcgctcaatttacgaagacgccttgtttactcgcgaaaataacaaggaaggtaacattaccgacactgaattcgaagtctacatgaaccttcttgataacatgatgaacgagttgcaagagctccctaaaaaagcacccgatttaatggtctacgcagaaaccgactttgacaccatcctctaccggatccgtaagcgcggtcgtgactacgaacaattcgacaataatccagaattagagtcttactactacaaaatgtggtcagcttataaagaatggtatgaagaatacgatgcaagtcctaagatgaagattgatttacaaaaatatgatttatcaaacgacgacaacaccaaaatcattcttagtcaaatcgaccgtaagctaaaagaaatccgggttgaggaacctgttcataaggcaatttagtttaagtaaccatcttaatgtataccattattacgtaaaacattttattcagttactaaccaaatttccatcaaaagctagaaaggcatctaaactaatttagagcgcttttctagcttttatttttacttccaagcatgtgaaataattcctataccatttcgcaatcacttattgtaaacgctaccaaatgtgcttataatttaattgtactaaaaatcaaaggaggaatcaccatgtctaaaccacgcacccgctggtacactaccgttagcatagtcgttatgtttctgttttccctcaccgtcacttcggccaaggcccaatccaaccccgccgatctagacggtcaatctgccaccaccattaccaaacaactcaaaaatcaccaatacgatgagcaagcgttaatgcagtatacatatcaaaaaattaaccagcaaaatcccagtctcaacaacgtcatttaccaaaatccttccgacgcactaaaacaactgcagtccctacaaaaaactgatcggcaacagcctttttacggcgtcccgcttttaatcaaggggttgggacaagcatatcaaggttatcccaacaccgatggactgcctttcttaaaaaaggaaacttatcccaccaccaaagtattcgtcaaaaaattacaaaaaatgggtttcgtgatccttggagaaactaactatccagaaatgggcttaattaacatcaccaattctaatttaaacggggtcgcccacaacccatggaatttactatttaataccggcggttcttccggtggtgcaacggcaagcgtagccgctaacgaagttccgattgcgactggaaacgatgccggtggctctctacgaattccagcttcctggtcgggtgtaattggtttgaaacccactcaaggattgatcgttggtgactcaaccactccttcagtcgttaacttcgcggacactcgggatatcaccgatacccaaacccttttaaagggactcacgaaccccaaacaagcccaaatgttacaaaaagttcctaagaatttgaaagatttaacaattgcttactcactaaaatctccggtaggaactccggttagtcaagacgctatcaatgcggtacaacaatcggtcaatttcttacggcaacaaggatttaaagtcgtccaaaaagatagtccggttgacggagtaaaaatgatgcagacctactatttaggcgcacttgaagacggagccaacgccagtgaaaaattaggccgaccactgactagtcaagacgttaaggataagctcgtcagtcccatgacttacgccctttacgaagcaagtcagaaagctcctaagtctactaccaatactttcatgaaggaattagctctcgttcatcgccaaatgactgcgttccacaagcagtatccaatttacttaactccaacaacggccactactgcgccactgaatagcgatccagcttaccttcctaagtacgttgatcaaatgatgaatattaaggatctgcctttccagcaacaaatgcagttgatttacgattcctggctccatggcttaactaagacgccgtttactcaattagctaaccttgctggggaacccgcactcagtttgccaacctacgtgagcccgtccggtttaccattaggtgtgcagttacaaggcagccaaggcagtgatgccacgttgcttgcaattgggaagatttttgaaaaggaacatcaatttaaattcttaaacgctaactacccaactagtgatgcgtcatcacagcaaaccaccaccactactaaatcttccaatgctaactcactgaaacagctacctcaaaccgatgagacctcagtagattggccaatctacgtggggctgattctattagggagtggaattatggttggctaccggatttaccgtcctcgtcgttaagttgatttttaaaattgaattttaatggcttagcagcgaaattaatgttcgctgctttttgctatgtatagggtatttaacattcttaatttcaatatctatcgtgatttaaagcatactaaaaagcagcggtggaaaatcgcttttccatcccctgctttaataatttacttaattattttttacaatgaccacgtctggtgcagcattttccactacgtagctagcagtagaacccaagattacttgagcaaccgtgcccatccccgtagcacctaacacgatcaaatcaacgtcatattctttaggtagcgtgtaacttaacattgatttaggactcccctgtttaaagaccacttcaatgtcttctgcaggcaacccctgttgttgggcatcttgctttaatttttcgagggtggttttccattgatctaacgtatcttgtaaatcaattcctgtttcaataacgccaaagcctaatgaaacacttgcggtgttagcatgttgctttttcatcacacttgcaataatcagttttgcatggtttgacttagcaatctccaccgctcgattaaatgcagccattgattctggagagccatcgtagccgaataaaattttcttataatccataatacacaccaacctttcaaagtctattataccaatttagcgctttcagcatagttttttatttgagttttcccgaattatttattaaagactttgcgttatactaaaaccacgaggtgaacaaaatgcttaaaatcaatcgacaaactttaaaaagccactggcccgtgcgccaaaaacagagccataagggcacttatggtcatttattattaattgctggaaacgcacaatacggcggggcgggaattttagccgcctccgctgccgtttacgctggaggtggtttagtaaccttagcaaccgctaaaaataattttaccgcggtccgtgcaactttagcagaaattatgttgatcgattttaccgactttgatcaacttagccaatccttagcaaacgcaacgggcgtcgtgattggtcctggtttgggcactgattctactagtctggccgtccttaatttcaccctgtcccacattgccgaaggagtaccgttaattattgacggatcggcaatcgatttagtagcccaacacgatttgcaagtttcccaccacccgacaatttatacgcctcaccaaatggaatggcaacgcctatcgggaattaaaatcgcggaccagtcggtggagcaaaatcaagccgtggtagatcaattaaacgccaccgtcgttttaaagcattaccacaccgaaatctacacacccaacgcgccggttgcccaaataatggctggtaatcccgggatggcaactgggggctcgggcgattccttaaccggtattttacttgccttaattgctcaagctaactcggtaaatgaaggggttcgcttgggaactttcttgcatagttatacggcggacctcatttacgaacatgaagcagtcgtgctaccccatcggttaattcgccggctgcctgccgttttaaaacagctaacccaaccataagttttgctaaataaaataccagtggtcaggaatctctacgcgccctttccaacaattttctcaattagttggttttgcgtttcgtacctaaccactggtattttattattctgtttttaatttttcaatttcttcatcgcttagttcccgataggttcccggtagcaaaccttcttctaactgtagcggtccaaaactaattcgttttaggctaacaacccgctcgccaagactgccaaacattcgccgtacctgatgatacttaccttccttcaaggtcacgtgaacgagggtttgctcatccagcgcggaataatttaggatggtcaggtcggctggctttaattgggtaccgtctttcaaaaccattccgtcggcaaactgcttaactgccggatcggtaatttggccggtcaccacggcttcgtacgtcttttgaacgtgccgttcgggcgctaacagttggtgggctaaggggccgttgttggtaatcaataataacccttcggtatccttatcaaggcggcctactgggaagagatccttccgaaaatcaactttattaaataaatccatcaccgtcttttgcttgcggtcttccgtggcagtcaccacaccaaggggtttattcatcataaagtagaagtactgctgataagtaatcacctgttctcccaaacgaacttggtcaaccacggggtcaaccttcacccgtccagatttagccaccacgtcattaacaaaaacggccttttccttaattaatttccgaatctgacttcgagtacctacattcatatcgtgcaaaaacttatcaactcgcacaggatcccccctacttaattttaagcattcttcgtaagcccgcagcacgtccgccgataatttcatcagctaagcgacttttaaggacacaaactacgtaaaagagcccgcctaacgtagccgccactaaaatcacgatcagtgcttgaaccttattagccggattcatcactagatacaacccgttggtcactacaaacgcaatgaaaaaggtcccaaaagaataagtaataattttcccgataaagccattgatcttatcataatctaacccgtattcacggttaatatggcgtaagattaaccagttaactacggcaaatccaattgcggtcgaaattagcgaacccactgccgagaaaatggctaccatcggaaattggaaaataactttaacgatcattcccaccacaaaatacttcacagctaggacgttttcgccaattccttgcatcacggcagaaattaccgtaaacaatcccaagacgattgccacgtaggagttgaactgcaaaattgcggtacccacgtcgctgagatggtaaaacaaagtgtaggccggttgggcaactgctgccatccctaaggcggacggaatcatcaaaaaggcaaatagtaaaattgagtccgccacttgtcggctaatttccgcccggtccccccgggtcttggcttccgataaaatcggcactgacgtaaccgctagtgcagatgccaacgaaattacaatcattactaatttgttagcgttaaaggcgaaaatcgcaaacatattatttaaaacggtggccgaataatcactgaccgaccgcataatccgaaagaaagtgtattggtcaatcaactgaaaaattgtgattgctgaaccaataataataaacggaactgcttgcgcgataatttctttgtacaaactagtagtcgatattgccaggccgttcacactatgttgggataaataccttagccgcctgcgatacttaacaaagtacccaatcaacaccagtaaaccgcccaaggcaccaataaaggcggcaaacgtggattgggccactccataaacccagtcaccatggtttttgtacataattaagtacgcagttaccaacatataggccacccgcgctagttgctcaataaattgagaaaccgccgatggccccatttcttgatatccttggaaaaatccccgggtcaaactcatcgtgggaattaccaaaacggcccaagctaaggcgtggagcacggtagttacgtttggatccccgtcgtttaaaaagggtgctccaaagaacaaaattgccgcacaaacaacccccgttcctaccgatagtagtaacccccgcttatacaaacgctgacctaacgcaaactcgttaatggcgttatagtgggcgacctgtttggaaattgcggatgggattccggcaattgccgcgatcaaaaagaagctatagatattatagcccttggtatacagggcgtttgcttgatcactataaactccaaaccaaattacccacgggataatataaatcgcacctaaaattcgcgaaaaaatactgcccgctgtcatccaagccgacccttccagcatcttagctttggaagaagaattaccactattctcccttaacggttgcgagcctaagtattgtgattccgcggtatcaaattcagatggtttatccattttaaaacctactttcactagtcaatctacattattttaatacacttagcgacccccgacaattaaatttcaaagacaattaccttttgaataggaatacaaatcgatcatagatttgaaaactagtttttctttaatcgccagacttttttaaaaagacttttcaactaaaaaggggttagaatccaccctgaattctaacccctaatttagtttttaactacgtcgcgaatatagcttcgtttcacactaaactttattttgcaacgatgttaacgatcttattcgggatgacgatcacctttttgatgtctttttccgcagtccattgttggatgcgttcatccgctaaagcaattttttctaattcagcttggtcaaggtccttttcaacctctaccttactccgtacttttccgttaacttgtagaatcacttgcacggtgtcttgtactaacttactttcatcataagttggccaagtttcgtaagtgatggtttcgtcatgacccatgatttgccaaatttcttcggcaacgtgtggaatgattggcgagagtaacttcacaaggccttccatgtataccattggtaatgcgtccgccttgtatgcttcgttaacgaagaccatcatttgcgaaatggcagtgttaaagcgcatgttttcgtagtcttccgtaaccttcttaaccgtttggttgtaaatcaagtctaacttgtggtcgttaatcatcgtgatccggtctcgcaaatgattattatcgtcaatcattagccgccaaacccgctcgatccacttccgactaccattcaagccttcttcactccaagccacggattcggtcaacggacccatgaacatttcgtagagccggagagtatctgcaccaaaccgttctacgatgtcgtccgggttaaccacgttgcctttggacttagacattttttcgtggttgcttcccaagatcatcccttggttaactagtttttggaacggttccttagttggcaccactccaagatcataaagaaccttgtgccagaaccgcgcgtatagcaagtgaagcaccgcgtgttctgcaccaccaacgtacaagtctaccggtaaccattccttgagtaaatcttcgtcggcaatcttgttttggttcttaggatccacgtaacgtaagaagtaccaggaactgcctgcccattgtggcatggtgttggtttcccgccggcctttccgtccattttcgtcaaccacgttcaaccaatcctctaagttagcgagtggactttcacccgtaccagaaggtttgatattgtccgtagcaggtaaccgtaacggaagttcatcttcaggaaccagcgtagtttcgccgtcttcccaatgaattaccggaattggttcgccccagtaacgttggcgagagaagacccagtcgcgcaaccggtagttaacctttttatgaccagctccgtgttcttctaaccaatccaacattttatcaatagcttcttgcttgtttaaaccatctaagaaaccagaattaatgtgtgggccatcgccagtataagcttcttcatcaaggttgccgccttcaataaccggcacaatgtcaatcttgaactttttagcaaattcgtaatcgcgagggtcgtgagccggaaccgccatcaccgctccggtaccgtacgaagccaatacgtaatccgcaatccaaattgggattttcttgccgttaacggggttaactgcgtaactaccagtgaagactccggtcttgtccttattcaaatcggtccgttccaagtctgacttagtcgcgaccgcttgcttgtattcttcaaccgctgccttgctttcaagggtggtcaattggtcaactagcggatgttctggcgaaataactaagtacgttgccccatacaaagtgtcggcacgggtggtaaagatttcgatcttttggtcactgtcttccacatcaaagaagacgctggccccaatcgaacgaccaatccaattcttttgcatttccttaatgctgtcaggccaatctactaaatctaagtcatcgatcaaccggtctgcgtaagcagtgatttttaagatccattgtttcattggcttccggtaaactgggaaaccaccacgttcagtctttccgttcaccacttcttcgttagccacaaccgtaccacccattaagtcgggcgcccagttaaccaacgtttctttttcgtaagccaacccctttttgtagagttgttcaaaaatccattgggtccacttgtaatattcgggatcggtcgtgttaacttcccgtgaccaatcgtatgaaaaacctagggactggatttgacgtttaaagttcttaatattgtgcgcagtaaagtccttcgggttgttccccgtcttcattgcgtattgttcggcaggtaatccaaaggcatcccaccccattggatgtaataccttgtatccttgcatccgcttcatccgggacataatatctgtagcagtatagccttcaggatggcccacgtgcagtccttgcccagatgggtatgggaacatatctaaagcatagtacttcggcttttgttcactttcaaccgttttaaaagtctcgtgtttttgccaatagcgttgccacttaggttcaatttctttatgattgtaagccatattttcctccattaattatttactggttgcttccggattaatttaaccgtgcttggtagccattgctagatgaattggcgaattttttaaaataaaaaagcctaaagactctcaaaaagaatctttaggacgaaaatttccgcggtaccacctagttttgctaacgcacactcaaatccataacgcggaacacgccatcccctacttaaagttcaaggacagatttacaaagacgagttcactaaagttactccggattcgcaccaaccatccgttctctgacagtaaacttttagctactacttctttaaccagtaatatttagatagcattatcataacagtaaccaccaacgattacaactagatatggtaaaattaatcttaattgttaaaggagaatgaaatgcgatttaaaaagtttggttggttaattttaaactggttacccctgctaggcctgctgaccttagttatctcggtcagcaaccgttggaattgggtacatacatacgaccgttatctacaaaaaatcattcacggctggcaaagtccggggctaaccccgctggtcaaaatttatacccaattggggaacgcaaaacccttcatttttatcagcatcgtgatcttaggaatgctgctatggcggggatatgaccgcttagccgccttcttccttgcaaacgtggtgctcggcaacgcgatcaaccacctgattaaactttggattcagcgtccccgcccacattttcgtttaatcacgattggggggtacagttttcccagcgggcattcagtggcggcaatgctgctatttggtagtttaattttcatcactacccaaacggtccgctcccctaaatggcggattagctggatcttaacctgcataatcctgatgctccttctgggattatcacgcgtctacctaaacgtccactatcccagcgacgttacggctggactactactgggtttggtaatcttgcaaaccacccactggatattttatcgaaagaaggaatcccaacatgcttgataacgcaatgcagtacagccaccggttgttggcagaggtcgtacaacctggtgaccacgttgttgacgcaaccatgggcaacggtcacgacacccttttcttggccaatttagtacaatcacaaggacgagtgttcagttttgacatccaagcagcggccttatccgcgacggaagcacggttagaaaagcagttgcctgatcaccaacacgtgcaactaatccaagatagtcacgaccaattagcacaatacgtggataccccgatttccggtgccgtttttaacctcggctacctgccttgtggtgacaagcaaatcatcacccattcggcgtctaccattgtggcagtacaacaatgcctgcaactattaaaagttggtggtcgggtcgttctagtttgttattacggccatcccggaggtgccgctgaattagctaaattgcttgagtttactgcaaatttagatcaacaccaatttacctgtttacgctacgaattcattaaccaagtacatcaaccgccaatcctattggcaattgaacgtcgaaaataattctttatataaaaatgggaaagcatcccttctgcaactttaatatcgttgctagaagtggaggactttcccatttttgttatttatttttttgagtacgcggccgactaaacgcattaattacgattgcaacaataatcaaaatgaaaccgcaaatgtagatattgtgtaacgcgctgtataaaatgtcgcgcaacgtcggtaataaatcagccggtagctgtttagcagtttgtggattaattacctgattcatcatcgtcatgttaatccgaggatggtgggcaatgcccatgttgatcgtgccgttcataatgatgccaaatacggacatcatgatggtctgacccaacgtttttgccaaggtattaaacgaggtcgccaccccgattcgatccttcgaaactagttgctgggagattaccaaagtcgatgtaatcgtaatcccaaacccaactcctaaaatggctgcaataaagaagaaggcgacgaacggtgtcgaagcaggaattactgctaataagaagcttccgattgctaagatagttaagctgattcgcaaaatttggttagcctttagtttaactagcatcttgccagctaaaaaggaaccaaagatccataacacggagctaggcgttaccgcaaatccagctaacgaagcgggtaatcccaaaattccctgcgtccaagttggtaaatagacttcgaacccaatcaacaatcccgatactagcatggtcgcaacgttttgaataacaaacgtccggtcgttgaacaagtcgaggaaaataatcggatcttccgcacgtcgttcctgccgaataaagagcgcgccggccaccacaaagatgataaatgacaatcccaaaattaatttagaagcggtgctttctcctaacaactggaagccgtacattaagcccaatagtgacaacattagccatacgctgccccaatagtcgatctttttgcggtgaacgctaacttcttctttcaggtaaagctggattaggataattgtaataatcccaattggcacgttaataaagaaaatccagtgccaactaaggttatcaacgataaagccccctaatagcggagcaatgattgaggcaattccccaagcagaaccgttaagtcccattaccttcgcgcgcttttccaaagaataaatatccgcgataatcgtgttggaaactggcataattgaaccggccccaattccctgtaaagctcgccaaataattagcgtagtcatcgagtgggctaacccacttaacattgaaccgattaaaaaaatgataatcccaattataaaaacgcgtttgcgtccaaaaatatcagataatttcccgtagatgggggtaaaaattgcgttcgtcaataagaagattgaaattacccaattcatcaaattaactccgtgcaagtcccccacaatggttggcatcgcggttgaaacgatcgttccttcaattgccgacataaaggtggcaacaaaaatcgcaaccgtgaccaacgcaacgtttgtttgctttttcttcatcataacctcacgtttaaaatgttcatttttatttatagtaataatataaaacaaggctgggaaaaattcccagcctctccacaaatttttgtgcacccttttaaacgattactttaaagaaacgccattttaaagtccgtgatgcaccgggttttttcccgtttaaattattgatttatttttggaaaaatgcttttaactcagcaaccttatcagtcttttcccatggaagatccacgtcggtccgcccaaaatgaccgtaagcagccgtttgtttgtaaattggccgttttaagtcaagcatttcaataatgccggctggacgaaggtcgaagatttgccgtactgccttagtaagggcttcttcagaaactttaccagttccaaacgtgtccaccattactgaaacaggttcagcaaccccgatggcgtaagcaatttgaacttccgccttcttagctaagtcagctgccacaatatttttagcaatgtaacgagcagcgtaacttgcagaacggtctaccttggttgcgtcctttccagagaaagcgcccccgccatggtgagctgccccaccataggtatcaacgatgattttacgaccggttaatccggcgtctccttggggaccaccaattacgaagcgaccggtagggttaatgtagaagttagtcttttcatcgagcagttcagctggaataacttccttaataactttttcgataacgtctttgcgaatttgctctaaagttacgtcaggatcgtgttgggtacttaacacgaccgtgtcaacccgcactggttgatcattgtcgtcgtattcaacggtaacttcggccttggcatcgggacgaagataactaatgacctgttctttacgtaacttagcaatccgttgcatcaaatgatggctaagcatgattggcaacggcattaattccttagtttcgtcagtagcgtaaccaaacatgagtccttggtcaccggcaccaatccggttaagccggtcttcgtgtccttcgcgtgtttcaagcgaatcgtccaccccttgggcaatatctggcgattgttcatcaatggcaacgattaccgcacagttttcgccgtcaaagccatattcgccaccaacgtagccaatgtccttaatcgttttccgaacgaccttttggatatcaatgtaagcagtcgtggagatttcaccaaccaccactaccaaacccgtggttacggtcgtttcacaagcaacccgagcatctggatcatttttcaatagttcgtctaaaattgcatcactaatttgatccgcaattttatctggatgtccttcagaaacggattctgaagtaaataaatgtctttctgacatgttaattccccctaaattaatttcggttacaaggatcttttggatatctaatcctatcgggaacactagtaacttattaagtttagcataatcgttctttcttttaaagttaggttgacgcttcatctagttttggatacgattgaacacagagaagataaggagtttttcatgaataagataaaaatacctaaaattaattatcacgttgaccggaaaagctatttaccagcgattttggcggttatcctaaccagcaccatttggtattttagcggtcattttagttcggagcctttcaaacataatttaacggtccaaatcatctttttcttagcaagctttatggctaatttcattacttttgaccaattaacgaataaaaccaatttgcgactaattgctccactagccgtaattccagttgcgttctttatcattttattagtcagtaaggagcgttacgtttctcttctagggttgctaactttggtaccgtttgtctccgtttttttaccttttcaaggcaaaaacggcgtaggactaattagttttgcgtttagcattagcgttttaagtccgattgcctttttctatattcgtaacgcatttgttagcagcatgtttttgaaaacttgcttattattgtgcttagtttttttgatgattctattctctgttttcgtggcacatcccgaacagtttatctatcttgaaattgggctgctggtggtcatcaccattttcggctttgtactatttaaacaatggagcgcggtactttatccaatgattggcatattgggttggtatcttccccgggttaagcttccccgcaattttattttgctagttttaatcattttaatctgtgtcacctttttatttacggccggtcattaattaattagccattagtaatcagtattctggttgctaatggttttttattgtttaagataacttgtttatgtgaaaggctcaccttcctatataaagtattgcaacgtgcaattgatagatatagtaaagcaactgggattaatcgccgtgttttcgattattaatcctagttctttcatatctcacttggaacttttctacaatacaaaaaagccatccgtttaataaacgaatggcttttgcttaagtctctttcaaagacggtcctaacgagactcgaactcgtgatctcctgcgtgacaggcaggcgtcctaaccaactagaccataggaccaattaattgcgggagcaggatttgaacctacgaccttcgggttatgagcccgacgagctaccagactgctccatcccgcgataatattaatataaatatgacaaaaaatgacccgtacgggattcgaacccatgttactgccgtgaaagggcagtgtcttaaccacttgaccaacgggtcatacttataataagaactaacggagaaggagggattcgaaccctcgcgccgcttgcgcgacctacacccttagcaggggcgcctcttcagccacttgagtacttctccaaatgggcctaaatggactcgaaccatcgacctcacgcttatcaggcgtgcgctctaaccagctgagctataggcccatacttaaagcgggtgacgagaatcgaactcgcgacaacagcttggaaggctgtggttttaccactaaactacacccgcaaaataaatattaaattttcaatggcgcgggacagaatcgaactgccgacacatggagcttcaatccattgctctaccgactgagctaccgagccattacggtcctaacgagactcgaactcgtgatctcctgcgtgacaggcaggcgtcctaaccaactagaccataggaccataattgcgggagcaggatttgaacctacgaccttcgggttatgagcccgacgagctaccagactgctccatcccgcgataattaaaaaggaggatgagagattcgaactctcgcgtggtttgacccacctgacggttttcaagaccgttcccttcagccagacttgggtaatcctccataatacaaatatacgtttcactgcccttactaacaaaaatgctagatggaccttgtaggactcgaacctacgaccgaacggttatgagccgtttgctctaaccaactgagctaaaggtccaagttcgtatattaaccctatcgcggcggaggggatcgaacccccgacctcccgggtatgaaccggacgctctagccagctgagctacaccgcgatctatttaattaataaatgtttatcaacatttaatcgggaagacaggattcgaacctgcgaccccctggtcccaaaccaggtgctctaccaagctgagctacttcccgtttaaaacaatgcacccagtaggagtcgaacctacaaccttctgattcgtagtcagacactctatccagttgcgctatgggtgcaatacaaatgccgaggaccgggatcgaaccggtacggtcatcactgaccgcaggattttaagtcctgtgcgtctgccaattccgccaccccggcattttataaaagtagtaaatacttactacgaagcggaagacgggattcgaacccgcgacccccaccatggcaaggtgatgttctaccactgaactacttccgcatgatcgatatgccgactagaggattcgaacctccgaccctctgtttacaagacagatgctctgccaactgagctaagtcggcattacctttatataatgccatatattcaattatatgtcacagcacttttagtgctatgagccgtgacaggctcgaactgtcgaccctctgattaaaagtcagatgctctaccaactgagctaacggctcaagataatggaggatacagggctcgaacctgtgacctcctgcttgtaaggcagatgctctcccaactgagctaatcctccataattaaatgtactatacactcatctccggcacccgtcaacacttttgtgacatttattttaatttttgtgcaaaaagttggataaagctgcaccaacccccgaatatgcttccttaaccgttgataatccacctttacagtccgtcattcgtgttgtactttagaactgttataaacaaaagcaaaggaagcgacttattttatgactccattatctaaaaaagcttaccgttggttcgtcgccacgctactgcttggtacgtttaccatgtcgataagtcaatcatccctgtcaaccgcttatcccaccttcatgcattactttaacctaccggctagcacggtcgcctggctcaccaccggctttatgttaatcatgtcggtagtgatgcccctttcgccgtggatgctaaataaccttaatttcaaacgaatgtacattagcttattgctaattttcattatcggaaccttcatcattatttttgcgccaaatttcgcaatgatgatggtcgggcggttaatggaaggtttctccgttggggtactatttcccacataccagtcggtaattttgcagatcactcccgaagaacaacggggagccaccatgggaaccgttgacctagttatgggttcggcccttgcagtgggaccgattctttccggaataattctacaaatctttaattggcagtcaatcttcatcttctttaactgtctattaatcctagtcacactgctagcgttcaaaaccatcgttagtcccgtacagcaaagccattccgagttagattttgtttcggtgctgctttctttaggaattatcggcttgctatattttatcaatgagattaaccaccagggttggaacctttcactcgccatcattttagtagtctcgttaggaatgttagccttgttcgttattcgtcagttccacttaactaacccactgcttcacctagaaattatgcgcattaaaaattttgaccttggggttttactaacggcgcttgcgtacatgtcgttgattaccgtcaccatcgtcatgccactttatttccaacaagttttacacctttcgccgttttggtcgggactcgcactagttcccgccgcggcccttttatcctggctcaaccggcaaagtggtaaattagctgaccggatcggttttaaacccgttatgatcatcggaatcgccatcttcatcgtgggctggtcgttaatgatcctcaacgtctttttagaaagtctggcaattgccattctggctacgatggtagtggaggccggaaacgcctttgtaatgatgcctgccaccacgctcggtgccaattcattgcctgaccatttaattccgcacggttcgtccatcattgccaccgttcgccaggtcctgggttcaacagccgtggtaattgccaccgtcattttaggtaccgacaatttcttgggcgtttttagttgttttctactattagaaatctgcgccctcttcttggcctttaaaatcaaagacgttcacaagtaatgtcatacttaacaaaaaaaggttcgcaacaacctaacttggtttgttgcgaaccctttttatcgttaattattttacccgtgctaagaaatacttcttcttaccgcgccgaacgatcacgaatttgccatcaaaatgactagctggatcaatttcagcgtccacatccgtaatcttttctccattaatccggatggcaccgttcttaatgtcttcccgggcttgacgccgagatggttcaattttcgtggtgtcgaccaaccacaaaacaatgttttccttcttgttttcgacttccacacttggcatgttcttgaaaccttgttcgatttcgcttgccgtgaggtccttcacatccccagagaagagggctgccgaaatatgttgtgcttcctctaccgcagccttgccgtggacgaattccgtaacttcttctgccaaacgccgttgtgcttcgcgtttttcaggagctgttttaaccgtttctgctaaccgttcaatttcttcatggctaaggaaagtaaagtacttcaagaacttaaccacgtcacggtcgtcttggtttaaccagaattggtagaattcgtaaggggttgtcttttcaggatcaagccaaacgttgccgccttctgatttaccaaatttcgttccatccgcctttagcaatagcggaattgtcaaaccataaaccttggcgtcctggccttccatccggtggattaaatcggtaccagctgtgatgtttccccattggtcaccaccaccaatttgcaattgcacgtcttcgtgcttgtataaatgcaagaaatcgaccgattgcaaaatttggtacgtgaattcggtaaaggaaattccgacttctagacgactagctacgatatccttagctaacattgtattaacgttgaataattttccgtagtcgcgcaagaaatctagcaaggacatttttgaaagccagtcgtaattgttcacaatccggaaattatccgtcccaaagaatttaaccaattgtttcttcaaggcttcttcattgtggtgaacttgttccatggattggagaacccgttcggatttcttacctgacggatccccaattgaacccgttccgccaccgattaagattaccggtttgtgtccggcttgttggaatcgtttcaaaaccatgaacgggatcaagtgcccaatgtgcatactgtccccagttgggtcaattcccgcatataaaccgattgatttttcttcggttaatttcttaagaccttcttcgtcggtttgctggttgattgcgccccgccaatctaattcgtcaataatgttcatcagttagtaccctccattctgttattaatcatcaatggaataaaaaacgcccccaatcaactgatcagggacgaaaaattccgcgttaccaccttgaattgagttattacactccgctcaacatcgataacgagatgatccgttcttttaagcagaaagctccatagtgtaattcaccgaatgggtcagtctggtttgcagctcccaccagatttctaattgctgaacccatcccgctactaggctacttcattgcttcaatatcgctgttaattttacggataattcaaactagtgtcaaccttatttagctaattcataaattgcgtgagcgtagattgcagctgcgttgacaatgtcttcaattgccatgtattcgttagcttggtgcataacgttttcccggccagggaactgcgctccaaaggcaaccccgcgctctaaaatccggccgtaggttcccccgccgatcaccatttcttgtcctgcttctccggtgtgttccgtgtaaatttgaagcaaagtctttaccaacggatcgtcagcaggaacgtaatgtggttctcgtgcgtgaccatgcaaagcaactttagcctcgaaatcagccaacgctgccgtcgcgttcttaatgatttcatccgtagagatggattgtgggtaacgaatattgataattaccgtaccagcttgtcctgcttggtagtcaaacaagtctggcgaaaccgttaaatcgcccatttgagggtccacggtattaatcttcaattggtgtccccgtgaatctaggtgcattttttctgcaattaacttaaggtaatcgttagccactttacggttcaagaagtcggctaagaaagtggccgcgttcaagcctgccttgggttccaaggcgtgtgcggacttacctactaagtcaaaggtgatttgttgtccggcaacattcattgccccggtaaggccgttttcacttaggtagtcttggtattcagcttgccaagcagcttcgtcaacgtctgcttttgctaagacaactgccttagcttcgcgaggaatcatgttgtccttgattccgcccttgaaagattgtaattcaaaatccccagttgctgattgtgcgggcacttcaacttcgaaagaagcaatccccttttccccgttaataattgggaattcagcatctggcgaaaaaccgaagtcgggtgtttgttcagttgccaaatagcggtccattccgtaccagtcagactcttcgtcagttcctaaaatcaaacgcaccttcttagaaactggtaacttaaggtccttaatgatttgtaaccctaggtaagcagccaaaacgggacccttatcatcgctaactccccgagcgtaaatccggccatctttgaccaccggcgcaaatgggtcggtattccaaccttcaccagcgggaacttcgtcaaggtgtcctaaaatacctaaaatttctttgccgtcgccatattcgacgtggcctgccacattttcaacgtttttggttgtaaatccgtctgcttcggcgaattctaacatcttcaaaagggctgccttaggtcccggaccaagtggtgcatccttttcggcatgttctacatcacgggaactgtcaattttcaacaattccattagacgttctaacatttgatctttacgttgctcaacttctgctttccaatcaatattcatgggctaataccacctttatatttttcatcaaaacttgtcgtaactatagtatgaattatacagaataacgttcatccgaggcaagaattccgcgaaacttaccggttaatatcttttacaaaaattacaacggctaatcattaatcaaatcatcccacgttttaaaactaaatatatttttttacagattttagcattttcaccctacctctaggtgatgtatcttccgcattaaaattatgccatttaaaatccttaataccaaccttcttaaacacacctctttttagcattctgattactgggtttccaaacacaattctatatatccacgtgggagcgcccgaaacggttaaaacccgcaccttagtacttgatgcaaataatcttctagttgcccccgcttgcttaatttgtccctttgctaaaactttgtctaaaaagccctttgtcattgcaggcataacttcccaccatattggaaatagcataatgatttcatcagccatttgtaggcgttcaaaataatcctgactttgtggatcaacaaaagatttagtccgccaatttattaagtcttgcttgctcatcacaggattaaaattatccttatgcaaatcgatcaaatccacttctgttccgtcgtcttccatcgctttgagtaaagcgaccaacaacgctgatgtgaaggatcttttatgcggctcgttgtattcagcttccataccgtaagggtggtcaaaaacaatcgcaacttttttcatattctctagctcttttcttgttaaaatatattcctgggaatatattgtataataacaccataagaacaaaatttaaatatacatgccgaggaatataaatgaacaacgaactatttgccgaattaaaaaaatatagagaacactccaacaaaactacaatcaaaaaaatgttgagcaaccctaatctttcaaacgtatttcaaaaactttctattactgagttagatgttattgctctgattgcagacaccaatcccaaaattagcgatttactgcctcacgtaaatatgactcaaggcgcggtttctaagcttgttaatcgactagttaaaaactcttttgttgaaaaatatcataaggagaacaaccaaaaagatacttatctaagacttaccgccttaggaaaacaggctgaaaaagcgcaccaacaatttcatgtagagctgaataaacagttaaaccaagccgtaaaaaatttttcagaaaaagaaattgaaactgccactaaagttttgaaacaaataaataaggtgcgcgacacgttggactaatctagactaattaaaaagttaagcaaaaaagagcttctcaagaaaattctaattcctgaaaagctctttaatttggaaattttgcgcacccaagtatgttcaaatttagtttatgctacttaatctaaaaacgacatcataattgttgcaacatattctttacgtatcaaatccatagtctaccaagttttgtgcacttgacttataaacctaagatactaataccagcttggtttgtctccatcggtattaggtttattgaccccgatggaatgcttaatttccgtattgttttgaattaaatcaactactacgtgtgcgatactcttccgtgaaacttccgttcccttgaagtcttcgcccttttgagtaaattcgtattcaatttcatcgtggttagttaaccatgctggccgaaccaccgtataatctaggtcactagcttcgataatgtccgctgctgaccgataacgagtaaggtagctacctagcgtggagttattccattccccaaacttgcccggtacttcgtcataaattcctagcgtagaaatccaaacgaggcgcttaacaccggtcgcgtccattgcttcaacgaccgccttggcttgatcggcgatgttattgcctgcaaggttagcgtaaaccgcatcaactccttgcatagcatcttttaattggtcaacgttagccgcatccccgtcaattaccgtttcccggtcagggttagatggagtgagtcgcttagcattccgtaagaaaagcttcagctcatcgtcggtttcttccataaattccttttctgctaattgagcaatttgcccgtgtgctcctaaaactaatactttttttgtcatttttatcaacctccactatcgattttaaccgcttacaaaaaatcagcaagtattaacacttttcggtatagggtgcgaaccttcagtgttatatacattttatagtgttctagtgaaaggccacaaagacttgccaaatggagatgacggtacaaatcagtattaccaacagatccccgatgatggtttccatttccatcaatgcaaaccggtttacgtctccatctacgtgatcagcacgtcgccgggatttaatcgcaatccagcagccgtatgcgcccagtaggcaagcaaacggcaccaaaaataacgcatttttattaatcatcccaccatcagcctttaacgtagccggaacttcgttttgtagcatcggtgccgtgaggagcacaatcagtaacggaacaaagggcaaccagcgcaaccagttaaaccggtttaacgctgcattttgcatccatccgggcaagtctttaatcattagccggggcttacgcgcgttggcaatcactttctgagcattttgggcgcgttgcgttcgttgctcagaagtcaatttttgcttatgtttactcattaaaatcaatctcccatccctaagtgaggcgctttatcgccttcttcaccatcataaaccattacataatttcatgcaggcggtttctaatttgcgcactaaccagcactctcattacattagttagttggttggttattcgtaataacgttgtttaaccaacctttgacaattgccgttttttatcaaaaaaatgcgactaaactttactcgtttagccacatttttattttctaagcgttcatttctgcgcgctttgcttcttcttgttgaagagcttgacggtcagcaatcttgaagaatgggtagtaaactagtccaccaattgctaggttaactaattgaattaccgcacccgaaatcttaccagttgccaagtaaccagaaattagtggcggagtggtccatggaaccgcaatcccaagtggcttagcaaccaacccaaacttcattgcgtagtaagtggttactaccgaaattaatggaacgataacgaacggaattgccattaccgggttcaataccattggaaccccgaagatgatcggttcattaatgttaaataaaccaggaatcgcagttaatttaccaatggcccggaagttttctgacttcgccaagaacattagcataaaggccaatgctaaggtttcaccagcaccaccaaagtgaatgaagttatccacgaattgttgggtaacgatgtttggtaacgccttgtgtgccttcgcagcgtcagcgttttccgccatcttacctaaccaaaccggcgccatgatcccaccaactacgttagaaccatgaataccgaatagccataggaagacaacgaagaattcagcaactaacattccgaagattgatccgccaactgcgttcaatggttgcgaaacgattaccgtgattacgtttggaatcgtcttaaaatcggtaaagctaaccaaaagccgtaacaaccacattcctaaaataattacaaatccaggaatcaatgatgaaaaggcgtgaccaacagcaggtggaaccgtgtctggcatcttaaattgccaatccttatgaatcatccaaacgaaggcgtcggttacgaataggccaatcagcaaagcttcaaacaagcccatcgaacctaattgagttaacggaacccaaaccgctcccgctttatcgacatttaatggaatcgttaacataaatgccgctaaggaaaccatacttgccgaaatggcgtcgattccatcgtaagacttcgctaattcaaacgaaatcccgattaccgctaccatcccgataatactaaacgttgcgttggtagcccagccgaccgtatcttgccaaccggcaccaaacaaactcgtcatcatgttcaaataagctggaattggaaattgactaataatcataaacactgaaccaataatgatcagtggcataactaaggcaaatccatcccgcaatgctaccaagtgacgagaagatgctactttacttgccaaaggcattagcttttcagcaaatccattggttttattgttgtcacccattacaacaacctccttataaataaatttgccggcatcccaataatcaaacgtgcaaaataagtgatatacccttgtaataccggccaaagcgttgaaatcgctttcacaagttcatattaacatttgtacctacaaattaaaaccaatatgcacaaatatgtaatttgtttttttagtaacccttttgagtcaaataatttgtcaaaattagttaactacggtaggaaatccacttttttgcttgaatgaccattttagaagtagtacagagcattagcttaacttttcgtgccggattaaaaatcatggtcgcacttttctgctgcctggtcgaaacgggctctggaacccaactctctccggttaaccaaaaataggcctagtcgcttaaaccgcgactaggcctatttttcgttaatcctcaagagctgcccgggttccagagccctctatcatcctaaaatcactccacggctgcaacgtttccaacagcatcatatcagttggtgccacgtggcccaccacgttcactcggccgttgttttctaaatcttgcaacgcaatttgggtttccgccttatattgtgcgtattcgttattcattactaacacgtcgcccttatgaattgggaccgtatggcgcgccggaacatcttcatccttataccaaacccgtgtcatggtgctccgcagtacgtaatcggaatgatccccccggtacgtgtgttggctatcgaaaataattttccgttcagtatcggtcaagccggcatccgcaatcacccgcacggttggttgcgaagcgttgaaggctgcggccgcttctttaagatccgcctcgctcacaccagcatttgaaattagaatatcgtcaattaagcctaacattttcaaatgcattatttgagtaaacaatgattggccgcgatgcatttctaacgagaccattccctcttgcaacggccaaggccccactgaaccagacggcgcgttcacaaaggccgccgtattaatattatgccgccggtattgttgggaagtttgcttaaagtagtccaaacctaatccggtgtagcgctgcggataaaagttatgcgatccgattagattttgccgatcgggagcataatccataatttggtcaatataatgggtaccgcgactcatgttgacctcgaccttcaatccgtacggattatgcgtcatccgcgcttcttccatccctgtgaaaccttcgtctaaccgtactgcccacgcgccaatgtcgtggaaaaatttaaggttatcgtatgacacgcccaattgtttaaacaacttcgggttcatgtccaccatggtgtccattcctaacgacttgccgtattcaattaagtctttgaaacgggccaccacctgatcttggtcccccttaatttgcaagaacgacgtgaagatccgttgaaaaccatatttacttgccaatttaatgtattctttggtttcctcaatccccattcggtcgggataaatcgaaatacctagtctacccattatttttcctccttattcacactggtctaaaccaatattgtattcgctttcagtatatcatagatagctaattgacgtgaaagcaccgtttgactgaaaaactagttgcgtgctaccctttttcatatagataaagagatcggggcaaatttaaatgactaaattaaccaattttctaagcgagtaccagcgaccaatccacgatccgctagaactagacctagccttatttagccggttggttgaattgccattaaccatggccactagtgaattagtgttgccggcgttactgccggatttttgtgctacgcttctcgcccagatccaggccaaggattatttaacccttccggccgatcggcaactattagaacagattgcccacagcaatcgttaccagaaggttactttagaaaagctcagtccgaataacgagcattttttagcaatcactttaggagtcaccaaaacactaaaagtgctcgcctttcggggacctaacggaacgctgcttagttggcgaaaggacctgcactttgcgctaacggaccccgaggctttgcaaaacgctgcccaagcatatttacaacgcagtttacaagctgacgatcgccaaatcatttgcgtgggcttttctcgcggcgctgcaattgccgccctagcttgtgatcatctgacaaccccggcaactcaacgcatccaacaggttttactgtttgaaagtccgggcttacccgtaggcaaataccattttgacgtacctgttttagaattgatggcgccgctttcggtattttccttagtggggatacatccctttccccagcgaaccgttaatagtttaaacgcggggatttggcagcatgaccttacttcatggaccgcggaccggacggggagttttgcaagcgccgtgggaatcgcggccccagcaggttttgatcaatcccccttcttcaaacagctgtctcctagcattaccaaagaagacgctaatcgaatcgttgacgttttattcgcggtatttcgagaagctaactacccgtcaattccagaattaattaagcattggaaccaatttaccggtctaatccaccaacaagttcacaatgaaaattcggtagttcaactttcagttaatcggattcaacaaattattttccaaaatgccgccactaatttacaaacggcgtctcgtcgataacttttttaaatttttttgaggagttttcccgctcaacactgggctgaggggaaactccctttttctttctccaacttactgatctaccaatttttaaatatgttatccttaaaccagtaaagaataaggagtgagtttaatgtcaaatgaatttccacaagctttaacaatcgccggttctgattccgatggtagcgcaggaatggaggctgatttaaacaccttccaacgtcgcgatgtccacggaatgtgcgtgatgaccgcttgcgttgccgggaactcttacggtattcaagctagtcatccgcttcctactgatttcgttgaccaagaatttcaatccctagccgacgatttcaaaatccgggctagcaaaaccggaatgttagctgatgcaccaatgattgaaaccgttgtcaaaaattatcaaaaattcgactttggtcctttagttttggatccggtcatcattaccaaacacggtgccttactattggaggaagacgcgtttgaaactttgaaggcgaagttgattccgttagctaccgtgattacccctaatttttatgaggcaatcaagttaaccggcattgacattcaaaatgacgatgacatggaacgcgctgcaaagatgttgcaggaaatgggcgctaaaaacgtggtccttaagggttcgcataaaccaggtgctcaaagcgaagtacgcgatttcgttcttctagaaaatggtgaaagcttctggatgagcgccccatacgtcgaaacggaccgggttaacggtacgggtgacgtactttcagcttgcatcactgctgaaattgctaagggaactgacattgccactgctattcgaatcggcaaacgcttcgttaccgccgcaattagcaattccattgctgtaggccacaaatatggtccggtaaatcacttagcaccgtttgaggactaagttaagccggtaaatgtagaaaataaaaataatattgatgaaattaaaaaagttgaggtaagaattttaattctaaccccaacttttttattttaatccgcactttccgttacttcttccgtagttgcttcaactttatcagtacccgcgttatttgccgcggcatccgtgtccgattcgtcagcttgatcgcttaccgtatcgttagaacttggcgctgaactagcactcccgccgctggtgcttgaatgataatggttgcctccgccttggtaggttggatagctgtaacttggagcactatagcttggagccacgtaaccaccgcccgcggttcccgtagtattcgttccagtattcgaatcgctggaactagccgcgctggatacatcatcgccagccgtaatatctacttctgcactgctgtcatctgcagacgaagattgttcgtccaccgatgaagattcttcagcagaagaagaggattccgccgcgctactttgattttgttcccactcgtggtaagcagccgaatcgttatatactttaaacttttgcgttccactagcttgatgatgtttagccgtagcggtaatcataaattcggcttccttagtgtgttcgcctaaatgtgcgttaaagattaactttccatccgcatccgccgttaaatttgctaccttcttagttttagtgttggttatcttaactttagcttttgagttagtcttgatcgtgatcaaaacgtttcccaaattattagtcttctttttcttagtaaccacttgcagcttggttggcgactgggtcgttttttctgaggaaaccgtcccgctcgacgccgctttcttactgcaagctcccaaggtgactgccatcgttaaagctgccatcaccgtgataattttcttcatcttccatcctccgccacatcgtttattaaccatattattacaattgattggcaatcggtcaatttattttctaaaaaacttgcaatcccctcaacttttttatatactcaatatacttactaaaagtaagccggacaattatagttacagaagggaagttcaatatgtcaaattcatttttagaaaacttaaaaaaacgtcgttcaatctacgcactaggtaaaaacgtaaagcttagcgaagacgaaattaccgaaatcatcgaagaagcaattcgccaatcaccaagcgcatttaatagccaatcaatccgtgcggttatcctttacggtaaggctcacgatgaactttgggatggaattttagatattttacacggcgaagttcctaacgaagaagcctttaaagctaccaaggcaaaggtcgaaggcgcatttaaggctggactcggaaccgtcctcttctacaccgatgaagacgtcatcgctgacttgaagaagaatttcccactatacaaagatgcatttgacatgtttggtgaacacggaatgggaattgctaacgtggacgtttggactgcattagctaacgaaggcattggcgcttctcttcaacactacaacccaattgctgacaaattcatcgcagaaaaattcgatattccagctaactggactttaaaggcacaaatgccattcggttcaattgaacaaccagctggcgataaggaatttatgccagatgacgaacgcttccgcgttattaaataattttttcatttaaaccaaatagcagctgagtaaaactaaaaatttttggtgcgttgccttcaacaacctcaaaaatcagtttgttccgcttaatcccaaaatgaccattacgccaaattcaggcataatggtcatttttagttgatgttcatcaattattcaattgctgtcccgcgctgtttttatttactcatcctagaatatttttccactgttgataaaccgttcttgcttgataagcctgggccgtttgttgagctccccggcttaatttttgccacaaatctgggtcctgtagaatttgttttactcgtcgggccatctgcgcctgatcaccatttgtgacgacaaacccgttgacattattttccactaaattttcaatgccgtagtctgtatagtaagcaaccaccggaaccccatgcgccatggcttcaatgacgctaatcccgccagcttcgtcgtaagccgtattaatgagtacctgtgcctgattatagaaattgtccattgatgtatccggcaagtaatcgccaaaaataacgtgctcggcaattcccatgtgttgggccatctgtttcaaacgacctaatagttgatgatcatttgtgtagccccggtattctaacgtcgcgtcgggaagctgatcaaacaaccgcaaaaaggctgccaacgcttcgtcggggcgccgatcactttctaaacgtccgctgaaaataacgtggtcgggagtacgcttctttttagaaacggtattagacaaagtcttagcatcaactaccgtatcagccgccacgtaaactggtgtctcgggaaattgtccttgaatcgccgtctgctgttgaacagtaggcacgatgattccatcaatttctcccggttctgcttgaaatgcgggtgtataggctgcataaacattgccgtgatggtccgcgtgcgctccatgaaaggctgaccatcgggattgggccttttcaacttgcataaccatcaaatccacgtcgcggtggtcggcaaccatgaccgctttgtcgtcttgttcagcaatttcgtttaagaagaataaaaacaagtcctcttgcgagtcaaaccggtaatcctgcccgtgataaccaatcagtttccacatggtgggctgtaattgatccgcaacgttcatataaacattttctaaaactacttctcctgctaaattcaaaaagcggcgcactcctaagctgccatcggggtggaagtaatcaactgacgatttgaaaccgcgccaatcgtaattatcccgggaaactaggttatcaaagcggtcgtaatattccacgtcccccatcaagccgaccgtccctggtaaaatattgatccgtgcaagctgtcggcccgcgtgatcgaccgtataataatcggggccatgatcaactagttggtattcatcaaacggcaactgcttaaattcccgtaccggtaccgtcacggttggcgtttgcgtagttccttgaaaataatcgtacatgtttaatacttgatcgccggccaatccaacgcgctgggcatcccgcaaccaaaagcggttataatccatcgttacgtaccgtgcgggatcattttgttggttaaaaaggcgggtccgttgggcttgagcatgctcagttcccgaattaaaggtgtaaattcctcggctaacaaaatacttcattattcaacatcctcccgaaattctggcattgcccgaagctttgctggccagcttgcttgtgcgtcatctagtagcgcctgccaagcttgccaaacttgtttttccgaataacgttcggccgaagtgtatgctccggtggagtaacgctgcgctaattgctgatcttgtaaaaccttaatgattgcttgcgccatcgctttataatcaccgtaaggtaccacgctaccattcacgtcattttccacaatctcattgggcccgtaattaacatcgtaagtaaaggaaattaatccgtgcgcaattccttccattacggctaagttgaagccctccatccgcgaagtcaatccaaacatcatcgcctgattttcaacttcatcaaccgcggtggtatatcccttaaaactaaccaccttttctaaatggttttcatgaataacctcttccactttccgtttagcttcgtaattattcgcagggtccgcataaccataaagatcgagcgtcacctccggaatcgtctggtggacgatggcaatcgcccgcactaggtcatcaaggtgcttctcccacgcaatccgagcaaaagccaccatttttccaaactgccgcttagcaactggaacttggggggcttgtcgtaactgctcgggcacaatgcctaccgggatggtaaataaccgggtatgggggtgaaaacgctcttgaacgtctgcagtttgcttttgggttgcactgataaaagcgtcgtagcgatccatcgaccgcaacgcaaattcataatgctggttcaacgtagaatccatgggcgcttgtgcatcactagcgtgcgagttgtgcaaatgaatcactcgataagctggtttttccatgtttaaaaaggcccagtcagctaaatgattacgatccaatacaaaaatattaggttgcttggtcgaccagaagtcgtcattcaactcatctagaaaatgcttcgtaaaggtctcaatcgtgtcgaattgataaacttttccgtgacgatccgttaatttccatcctgaaggtttaagctcaccagcccggttctgcttggtaaaagcttcaataactgttttaccttccggagttttccattcttcattttcaatctgattatcgggagtgtaccactgcgaaagggagacaaagcctcggtaatcgtagttgtccactcgataaagattaccaaagccgtcaaaaagttcggtagagactacccgctcctcgtcgcccgccacattaatccgagcgaccagttcctgagcaggcgttaccgctaaataccgctgattttccggttcatattggagttcaacgtccgcgaccccaaaatctaaatcagtggggtgaactatgtgacgttgcacttgtaaagcttgctggtagtagtcaaacatgttgatcaattgctggtcgtcaatcccagcggcctgcgtaaggcggtgggtgtccgcgctccaatcccgcaaaatcagccgacaatctaccttcatcttgttaaaaagctccagtcgttttaactccgcatgttcaatccctgatttctgctccggcatttgtgcattaataaaaaagatcattgatattacgcttttccttcctttaatcgcgattacttatctatgtattatagtacatacgctaaattaaagtgtgaacgacctataaagtttcttataaattcgttaacgggttggggaaaccatgctttgtctccccaacccttccggctaactaaattacggggccaatcgcaaaaaccgcgatcagccccgtaattctgttagtcctcatggtttatccgggtgccaaagcactcttatttatttgctcatcctcatcgcaatcttttcgcctactagcgtaaatactgatccaatcaggataattataattcccacaatggtattcaagtggattggatcccctaaaatcaacaacgacaaaattggtgctagcgccggtttaataaagaaaatcaacgaagcaatcggtactccagcttcacccattactacgaagtacaaaccaaaaccgacccccgtaaccaagaaacttatgtatgctaataacaaaatatttgaaagggtaatcccttgaaagaacggaatgtcgctaaatccttctagcccactaaaagccctgctgactaccggaatatgggtaattgccataaaaatcgctaactcgattgctccagcaataaacgaaaaacacgtcatggtcattccgccaaatcccagcttattcgagctaagtcgggttaaaatcccataaattgcaaaagtgatggaacttagcaagcccaacgtaattcctaagggattggtcaggttaaacggattaataattaccaacaatcccgctagcgttagaattacggccagtgtattggttcgcgacatcttttccttcagcaaaactaggccaatcaacatcccaaatgcagggttagcacttagtaaaattgcaattgtggcgggcagtgataactgaatagctagttgatacaacgtcatgctgactaacacgcatgaaaatccagtcattgaaaatgccgcaatgtcccgtcctttcaatcgacgtccctgttttttcaacgttttcattgtgaagggtaataatagcaatcccccgaataagaagcggataaaattcaactgaatcgggttaaacgtccctccagcaaccttcagcgcaatctccattgaactaaacaaaaaagtagaaatgacgacataaagcaaggtccttaacttcactaaaaaaacttctttctctaatataattatgtacatataccatcttaccactttattttcaggggattttcaaataaaaagtcgtatttctttgtaaatttaatgctcagtcttctactatttatttttctaaaaaaggtacaaaaaaagcgcaaacctaattgtcttcgctaatttatggaacttttcagctctcatccctaccaagaagcctttttaactcctggaatttgaccttcgtgcgccaatcttctaaagttcaaccgagacagctgaaatttgcgcatgtaagcatgcggtcgaccatctagcgcgtcgcgtcggtgaattctagttggtgaagcattccgcggcaacttactaagcccttggtaatccttttgtgccttcaacttttcgcgcaatgcggcatagcgcattaccgtttcttctattttcttttcctttgcaattttagacttttttgccaaatgagcactcccttactaaaaataattgtgcaaacagtatactgcctcacttactaaaagtaaaccattttgccttccacgttaccggaatcgcttacattttatccttaaataagccagcctgtttttcaacaatttccagcttggattgtgtcattttcaaaaattatttttcagcgcgggccatgttcatcaatcgaattatattacgagtgacaatcttaatatttacgatagcgtaccgcgtttccatcgaacgccttaacgagcttggccttctttgaatagagaaaactgctaccttttcgttcggataatggcgcattgaattgtctacttgtccacagatggctacggctggcacggacatcttcgtcgctaaatctagtacttgattaattacgtgcggagtttgcggatggtgggaaattttcccggtcccggtaataaacaagtccgcatcttctaacttttgtggtaaaccgactaagttagccattatgtcaccggttggaacgatttgtccgcctagaactgccaacgctcccccgattccaccatctacacctaaaccagcaacgtctcgcaagtccaagtttagttccttaataaccgtcatgaaaaagccgtccattcgcttatcaaaaacttcgatttgctttttggtaccgcccttatccattccccaggcccgctgtgcgccgcgatagcctgcataaggccggtcagtattagtggcaatcataatttcaacgtgattaaattgttggactacgctttctaaattgcgtacttctttaaaattggttgctaataagttcttgtcgcgcccaattaaatgtccctcttcatcataaaagttaacgcccaaagcttgaagtaaacctaatcctccatcactaactcccgtttctccggtaagaatgaggattcgttttgcaccgcgccctaacgcatcccggatttgagttcctaacccgaaactggttgctcggatgaatgatcctggtgatggcaaaatccggtgttttccagccgtgctagcggttgcaataatggctaacggagcttttttatagttagtagttaaatacggtgcgtctactggtcgacccattaaatcggtagttttaaaagggatttcctcgatttctcgtccccaccgttttaaaacatctaaaccgtctaatgcaccatcggaaattccagcagttactacttcaacttctggatcgattttaaagatactttcgcgaactgcttcgttaacttcctcgctacttaagcaatctttgaaagcatccgctgcaattacaactttcattttttcacctctcgaatcaaatgctcagtatgtacaatttataacattcataatcttatcatcttattatctgaaaaacagctactttattttacttttaaaaggaaatgtggagtgctgtttcacccactaactaatgacgctttaaaccatattttggaacctatttaaaatgaaatcaaaccacattagttttcttaaactattcattaaaaaccaatcacaccagaaaatgattataatctcatctattcagtattgaaacggctttctactggtcattctaacatgtactttaccatctgcgtatcaattaactataaaatgtgaaaaaatttggaatttattcacattatgcccttttattaaaaaacatctcctaaagatggtgatcacgtaattttgagttaattcgatccttttttgaaaacgataccaatttatcaaacccggctggtagctttttttaacatcgtagcttaaaatgacagtggaggtggtagcagtgacaagaaaaattggaattatcggaatggggcacgttggccaagccgttgcccaacaaataattactaacggttatacagatgatttagtattgattgaccaaaatgaagccaaagttggtgcagacgctttagattttgaagatgccatggctaacctgacttaccataccaatattgttgttaacgattacgccgctcttaaagatgcggatattatcatttcagcactcggaaaaatttcactcagtgacaaccctaacgttgatcgttttgcggaattaccacataatcgcaaacaagtgcgggaagttgctgaaaaaattaaggaaagcggttttgacgggattattattgccattactaatccggtagacgtaatcacttcgctctatcaagaagttaccggactgccaaaggaacacgtgattggcaccggtactctattagattcggctcggatgcaacgcgcggttgctaagggactcaacatcgaccctcgctccgtatccggatataaccttggtgaacacggcaactcccaattcaccgcatggtcaacggttcgcgttctcgatcggcccatcaaagagattgctaatgatcggggcttagacttacacgaaatcaatgaagaagctcggattggcgccggtgacgtaatgaagggtaaacactacaccaactatggagtggctgccgcggccgttcgcttagctaacgtagtgctaaacgacgcgcgagaagttttaccagtttctaacttccgggaagaatacggtacctacttatcttacccagccgtaattggtcgtgacgggattgttgaacagcttcagttgcaattaactgacgaagaactttataagttacgcaaatcagcacatttcattatgcaaaaaattgccgaagcagaataaatttcaacttaaaaacacaaaaatttgagaccaagcccataagtggctggtctcattttttattcgttctatcgtaacgaataaatatccattattgaaaagactgaaaacattttcagtctttttatttttaatgaaacgattagtttaacgttatacactttttaaagattttctatcaataattaacacgtttaaacgtaactacgagacatgttttgcagtagcgcgaaaatatctgtaattttaatcgtttcgtcacaccgcacttcaacttggtttcctagatcgcggatttcaaacttaatccattggtcgccaatattagctttaccattttgcgcctttaatacggaaataatcagatcatccccgccatctaagaagccaagcacggcgttttctcccagtaacacgttggtgaccttcaatgtcaaaccgggagtttccacttcactgtttcccaacctaattctttcaatcggcactattacactcatttgcgtgacctcctatcattcaaacaactaacaatctcgttacttgccctgaattatacatacgggaaattggaaagctgatcttttttgtccgaacagcgtcggattaattttacaatctaccatataaacattgcaggtaccagaataatcaggtctgatattagatgtatatacatacctcctctcaatgaatttgtagacttccatgcttgcgaatacggatatctagaaagtccaaccattaaacatggccatagttgaaaatcatatgtcacaatgtgcattattccaaatgcaagacaaccaattaaattacttaaaacccatccaaacttattgtttttaacatgaaaatacaacggtaacgtgattccagcaactaataactcttctcctacaattgaaactgaagttttaattacctctattacattagacaaaatcccgccgttatttgttgctcctacagcaggattagttggaaatgcattaacatctactaaactaaatattttccctacggctactattccccctttgataaggaacgacaatagtaatagcagtgccaatctccaaaaaaaggcctttccattggcttcatcatacttttgaattgtctataaccaaatattattaacaaacttgcactaccaaaaaacgtagtagacagccagttaaaactatacggagtaactgccccaacaactccaactattattaaagtcaaagcaattatcacatgcgttatttttataggtgttttattcattttgtctccctgctaaaataatagtaaaaggtggtatataactgacttccgttcattcccactagccaatcactaatttgtcgggtctgtgcttcctgataggctgggtaataatcccaaccttttttaaggtttttaaatccgtataccacaaattgagcacattgtgctcaattaattattacatttattttacattgacctaccgtgcttttcgtgttgtcttttttcttctccaattcatattccaattctttttgcgctttcttttgtttgttaagctcgtggtcttgattattctcgtaaagtaagctcatcagggtgtctgatagtaatttgttcaaatatcttgctggtgtgttttcgttatagttgacggctcgataatcaggcatattttctttacgaaaattatcatttctttggttatgctgttgtattccttttttagcctgttcaacttgtctagcagaaatctttttatcttgccctgcttccccaatgaataactgttgtgtccccctattcttcaatacacgtaacaaattagcgttttgaatctcatcagatttaacctgtccgcttagataagcaagtccctgggcatgttcctgggtcgtgaattgtactgccggattgtttttcaactggtctaaatcacgcttttctagtgatttaagttcaggattataataaacaactgctgtatataggcgttctttttcagtcattttgacttgatcaaggctcatatcagggaaagtcttacttaacacgttgttatattgcgtatcaaccacttgtttaatctcatttactgctgaaagttctttgatattcttcttcaaaacatcttgttgtttcttatcaaagtcacttaacaatgtaccttttgtacgcttaatatctgctagttgatagccattattagccaaaatatcactaatagtttccttagctcgctgttcttgcttttcaagcattaaccaactagcaaagggccgtttggtaaaggtcaaaacttgttggtttaaaatgttagttctgatcattgctaaacggtcttttaattcgtttcctgcaaacaccttttgttcactatctgtctctttgattaactcacgttgttctgcaatagttgtttgttcaaaatcaatatcgggataaagctttttaactgttcgactaacaaccttatctagtaactgatttgcctctgctaatgacttttcttgctggttaattgttactaatttctttgtcatatcttgcccgattgcttgcttaattgtggcactatttttccaattaaacagcatacgttgcttctcatctaggttttctaaactaacaaatgtttttagttgcttacttagttgtgcaaccatacgcttttcatcaaatgaatagtgacgttgtaacgtttctatacggcggatattatgaattttttcattggcatttttagcttctgcttttgcttgtctttgctgtttaacattgcggttaaattcttggcgtttttctttctgtgaattgataccctcgtgttgtgttgccacttcatcaattccttgttcttcatatgatttttcactaatgcgatcaggcaagtttttagcttctaaaacttggtttaccgcgttagcccatttattgcgccattctggtattttttctttcttatcccaatcaactagccatattttccttgacctaggaaatctactattttttgtatatgttttgttaccatttttgtctaaaatattctctcgtttgctctttaatccccacgttccattaggattaaatggacgattagttagcataacatgagcatgtggattgtctgggtggtctctatggatagcgacatccgcaaccatacctgaattaacaaaattttcttgtacatattttgttagtaaatatttttgctcttgttccgataattcaatcggtaaagcaacattaaattctttggcataacgtgaatttgctttacggtctttcttctcaacttcattccataattgttgcctatctttcgcccattctggtgcattttttggtgttaaaataaatgcttctggcatgacatcacgtttataaaagtaactttttccctctttatcagaaaatagtttttctccacttcgataactagcactagcaactgcactacgcatttttccagcgctaatattttgaaagctcatgtgaaaaattgccattgctgttatctccttcctttgtgggtttgtttttgatttttgttgtcgccataggcgacttttgatacatctttttagggttttagcacaacacaacttcatgttgtgtgtaagtgcgccttgaactaaaaaaaaaaccttttattttaatgatcaagttagctattttttagcgtcattaaacggaatgaaatgagtttaatgacgcttgcacatagaacatctatgtgcgtccgcaaaccgagcaaatctcggtcaaggctcggtcaaggtgcacttacactcttgacacttgtcaagagtagtttgccaaggatttcatccttggtttttccttgtctcagaaggctaacgccaaccattaattaattacattatgcaagatccaatggctataagataagcgggcactcatcgtaattaaccatggatgattcaccttaaaaatttgaatttccgtttctaagtacaggagtgttttaccatgattaaaggttaaaattggtgctgggaaatggggtctggtcacaaccttatgtacgctttgccgtgagttcatctcccaacgttcttttagatcttctcgtgataaaagttttggcaactgttctttctcaactaacacttgttttgtgagttgtgccgttagttcttccttagccgcattaggatgccaatcatttaaaatatcatatgctttattccctaactctaattccatgaatagccctcctatgatggcgtggttataagattctacaaaataaaatattcaccgcggatagtaaactttactatcatcgccatgaaatacttcaacgcttagatggtaataattatcatagataccagcttgatacatagcttgcgtgatgttgtgtagcatgggtggttctaagatacgttcacgtaacaaccagaaatgttcattatcattttgaataaacacacagcatcgtttatctcgcacattaaacacgcggatttcacggccgtcaacatagcggataatagattgtaaggctaaattagtattggtcatgtactcatcaaaattagttatgattcatcaccgaaataatgatccagtaatagataacccagcaagtcagtatcaccggtattatctatagttgcatcaaagacgtctgcagaataagtatggctagctgtatcatggccttgtttatctgacgctgtaatgatgttagctaatcccgaattattcatacgaggtttaatataggcataccgcacaattttggaccaattctcgtgctgctatggcgtagtcaaaccaagatgtactgtttttgctaaaggctaccaaattatggggctggataaatctttgatcctcaattttgggcgtacttaccccttggtcgaacggcctttttttgatttatcgtactgagctagccccactgtagcgcttggattcgagctaacagttgataaaacaaatcctgatagacgtggtggcgacttaattttagataaaattgccggccgctggtcaccagcttacccgctactttaaacagccataagcgcaaggttgtaacctgtaatcgctgatgttgtgcaggcaacaattggcgcatcaagctgactaaattataagcgaggacactgagcatcatgcgggcataatttggtataaattgcgagctagtcattttatccaggtaaaagccagctttggcttccttgatgtagttttccatttgaccccgttggtgataggcgtgaaacgcatcttcggcgacaaaactcgttaaattggacacgaggtattcatgttgaaataacaattcaccagctggtcgagttgatttaatatagatctggcgcggcttaggccatgatcgggcttgataagacgcgcgataataatggacctcggtctcagtccaattctgctaatcactgatctgaacaaaacgttcagccagttggttcagccgccgattggctttcaggcggatcaagtaaaaagtgtcgttggcttcacaagtttcgtataattctgaagtcgcaaagccactatccccgcggaccaagatatctgcgttcggtttgatttgatgatagtgctgtagtagtggtgtgataaagggggcaatatccgtactggtataaacattacctggacgcaattgagcctttaaacagtggcccgtttgcccgtcaaaagcgaccagcggatggtaacccgtggtaccgtaatgcgcattaaaggccgttttttcctgatgaccatgagtatcggcatgggtcgagtcaatatcgagaattagctgttgttgcttggcgccagtccacgcttggtcaagcaatgcttgattcaacgtttgtaatgaggtgatggtctgctcgtcacagcgttgcaaaaaacgggataacgacggttgtgaggtcaattgcggttgtgccaatagtaatttaaatgtagggtcatcgcgcaaactagtggcagctagatcggcagcgtagccggcgatcaactgcagcacgacctgctctagtagactaacgttgctgtaacgagcgtaatggcgctggtcatcaaaatggactaattgatacgctaaggtcgtgaaattgagttgcgccattaattctttgaccaacactagcccagcatcagtggaaagttcaccaccagtgtgcgaaatatgcaatttaggattgaaattaactcatttttccggtaaagttgccatgagaaggaccttctttcttttggtggatagctgacttgtggtgaatcaactataccaaatcggaggttctttttctgcactaaaaaggtgaaaaataaaaaacacagtaccgcccatgataacggggtgacactgtgcttggagaacttatggtgaataattcagggagttattgtcgtgttattggttgctattttttcagcataagaaaaagaccatattgctactcgtttatagccatatggtcttttatattagtcagcgaatggtgctttgcctagataagcactgatcatccaaatatttttatcggtttcatccttgaagccattaagcatatcttgagttgggaagtctttttcttcgtcagtaacttcgattcctttttggtattggtcacgtaggtacttgaattgatcaactagccgttgcatgaattcagtcatcgttaattgatcaaaagcgactttgtcatccggtaggccagtattttcaatgaattcgtgagttgttgccagtgggctgccgtttaaagcaatcaagcgttctgcaatttgatcgagctgttcgcttagttgatcgccatattcgtccatcagcggatggaggcggaagaagttttcaccgcgcatataccagtgcgtttgttgaacgttgacctttaattggctgatatcggcaatcagttgattgagttgtgcttttgattttggaaagtcataattgtaagttgtcataatgaaccccctcttcataactattggttacactaatactgtaacagttgtgaaagcgtttttcaaatcaaatacttgtggtccattggcggtataaatcttcgataattgctacggtgtggcaggtgagtgtcggcgtcataactgggctagtcagttgatgttgggaccagagttgattaaagtgctgaatctcaaaaacaaattcgctattttgagtgacctgtaacgaagtggcgtggtcagtattatcatataaagtggcgctgctggccttccagtagtcaggaatcacgattttaccatgactgccataaatgatcattctgctaggtagtggtgttttggcggtgatgaataggtggactaaaatattcttttcagtctgcaggatcacatcactttgttgatcagctgctggtgcctgtcgctgacagaggccgtgataactagtaaagcgttgcgctaataagtattgaatatagtctagcgggtaggaggcgctaccatgaaaagcactacctgcggctggttactattctcgaaggataaatggtcaacaccgcgtcatctataccattgataaagcaactaaaatagtcgaaatctactcatgttgggcccattatgaaagtggtgctcttgaaatgagcggtaaatctaattcccaaaaaaactagtgatttaatatgcgttataaattataatatcaaaataaataacccccaatgtctacattatagatattgggagttattctttcaacatttttgaggggttatttgttagttatagcccctaaattaaggaatgttttagtgaccacctaggatcatagttaactcatagcaaaactcctggtattttacttagaagtcaataaattaattggactgctttatggtggtaagttatgacgtattttaacacctttaattataaggcacaaaaaaagcgacacaattgttaagttatgacgcagtttatatattcatttagcggacattaacccatttattaataaaaactggacttagaatgcgtttctcaaacgtcaaaacatgaaaagacgcctatttctaggcgctttttacgattattgttgtaaagtttgttgggcttttttagctcttggctttttcaaatctggattatcctttgcacctgaagatggaaaggggactgcttcttctgcttatggtggtctaggcatggctttaggtaataacggatttaacgttatcggtgctttgttccttagccagtttcgactaggatttatagtctttggtatattcacatttgctggcgtattaattgcaactttgattgtccatgagccttctaatttagatgaaacctcaactaaaaagaaagaaaagttttctttaaaaaatgtaaagttaatttttccttcttggcaaattggcgcgactactacctagctcttataggaaaaatgtttcagggagttggaaactttgcaattacaggatacattttatatataatgaccgactttcttcatcgtggtaatcaaactcaatcttctatccaacttgttaacatgattatgcttatttttggcattttgatgggattagtcgctgggccactatctaataaatttaaaatactgaaattaccagtaggtctctcaactatcttattagcaattgcaggtctctccctgttcttcttaagaaataatactggtattattctttacgccttagctgccggtttaggaatgggcttatggaacgcacttgataatttattaaacttaaaagttatccccgatcaaaatcgtgttgcatttttcttaggtgtttacaacttaggtaatacaattacacaagctatcgcacccgttttagccgctgccgtcataagtctttttggttattctggaatttttattgtttcatttattttttccttgattggtggtatttcaatgctatcgattaaatcattaaaacgttagtaagatattttttagcaatccttatttaaagttaaggattgctttttgttctcttcagttgcaatcgcttgcaactcgcacctatcctctgctatgctcgtgccaacaatggtaattgtttattcacctaaatttaggatggaggtaattaaatgactgaaagttatcaatttgatgttttgtacttaggcgcggggcatggtgccttcgacggggcggttccactagctaatagtggtaaaaaagtcgccattatcgaagcggacaaaatcgggggaacttgtccaaaccgtggatgcaacgcgaaaattacgctggacaacccggttcaacttttacgccaccaagaacgccttgatggcattgtaaatggtgacttaaagctggattggactgccaatgtagaacatgaacacgaagtcatcgacggcttgccggacatgattactggtttactcgactctgttgacatcgaaattattcacggtcgtggaaaatttgttgatgctcacaccatcgaagtggatcaacagcgctacaccgctgacaaaatcgtgattgcaacggggctacgtccccaccatctagatgttatgggctcagaacttacgcatgacagtaccgattttatgaacctcaaacagcttcctgaaaatatcgtaattattggcgcgggctatatcggcatggaattttccacgattgccaatgctgccggcgcgaacgtcactgtacttttacgccataatcgggcgttgcgcaaatttaatcaagattacgtaaaacaagtcattgccgacctcgaaaaacgaggggtgaagttcatttacaacgctcaggtggatcgttttgaggaagacggttctcattttaccgtgtcttataacgatcacgaaaccctcaccaccgactggattttggatgctaccggacgaattcctaacatcgaaaacatcggattagacgaagtaggcgttagttacaatgctaacgggatcgaagttaacgatcatcttcaaactaacattgataacatctatgcttctggtgatgtgcttgataaagaacagcctaagctcaccccgactgcgatctttgaatctagttatttaacccaacttttcataggaaagactactgacgcaataaactatccgcccatcccaaccattgtctttacctcaccacaaatcgcacaggttggtatgagcgtcgaagaagctcagcaaaatcctgattacaccattaaaactaatcatcttcctgacggatggttccgccaagttgataaggaaacaattggtgataacaccttgatttacgatcaagaccatcatcttgtaggagcagctgaagttagtgaacatgctgccgatgcaattaacgttttattaccagcaattgagtttcaatatacagctgaacaactaggccgcatcgtacctctcttccctactttgggagcggatgtctggtcacagatttaaaaaaacgctgagcctcttttaaggagactcggcgtttttttattatttagtaaattcagcaattgcatcatcaatatgttgccgtactacctcaacatgatccatttcatcatcttctacatgtggtaaaggattacgtgctcgtcctacacttaccccacgtttagctaagattaacttcatcacatcatataaattacctttaaatgatgtcaattctgaaattaaatcattaattttaagttgaatttgaagagctttttcaaggtcatcctcacgaacgcaccgatccgcttccattaacaattctggataaacaccataagttccacctatacctgcatcggcccccattacgcgtccacctacaaattgttcatctggcccattgaaaacaatattatctttaccagcacgtaatttccacatattgatatccattactggcatggatgaattcttaaccccaataacttgttcttttgccatcatacgtttaaataagttttctgatagtgcataaccggttgtttgcggaatattatatataatgaaatctaaattagttacttccatcatgcttgtccaatatgcttcaattgcgtgttcaggtaatccaaagtaaattggtgggattgcagcaagggcatccactccaatactttcagcatgctttgctaactcgctttgaatctcatttcatgttttacgttcttacccctttctatattttatattggtgctattaaaaagccaattaaggcgtttatttttgtgtttcagccatttttatagattaaacggataaaattttagtcgttttaactataaaattgcttatatggcattttatagcttttaacgactatttacattttttgcatttctaattaattcagatactccgtccctaagtccattgataaattattcttcgctatctggtttgttgagtgttcaagcttgtattcacgttgtagtttagaactaccgtaattttcaaacatatttttcatagtgatatataaatagttctcgtaatttttaatctgtttatcgtcgcttcacaaagcattaaaataccgacgcaaggtttgtgtgatcttggtttgtaattctggttcatgatctaagataaaaaatagatgatgatctttgtgtaactcttggacatctcgtctagcatttagaataatcccaatagtttttttaatgattttaggattattatttgcccatagactaattagtcgtattgtttctggttcaaatggaatagggttattatcttcttctgtcaaaaattcttttgcatgttgtactaggtcttgattttgtttttcaatttgagcatttgaaaaattagcagtggaaaaatctagctgtgcagtctctttatagtatctattagtatctaagttattatattcttcttgattaactgcagaatttgcagttccgctcatatcaagggtttcagccgttttattagaaaaatcaggcattttataaacatcggttgctgtaagatggagttgtcctaaataaagccgattaggcaaattctttttttgctttggatcaaaccccacactttcttgtcgtaacaatccaaattcttctaattgctttttaatagaaattactttgtgttctgaacaattaagtaattcttttagttctaaattggtaaatataaaaaacactttattattttcaggtactgtaccctttcaagtttacactttaaataataaaaattagttggccttgccaaagcgatattctgctgcggtaaggtcatttcttttcgctgagataaatttctcggtaaaatatgtaatgccttctttgacttgttgttttagttctaccaacgtttgagctttaggaagatgagctatccaaattgctttgaaatcagcccaccagtgctcgattaccgcattatctgccggtgttcccggagctaagtagctatgctgtgcattgttaatcactaaatactggttgaatgcttttgaggtatatgctgctccacggtcagtatggataagcggagctaatgctccttcatttactcgtgccctttcaaatgctttaatagccccttccgcggtttcagtaggtgtaattaaccaacttactggatactggccatatagatctaataccacatgcagtcgaaccttattaagccgtactccatatgttatttctgtggtatccgtaacccaaacttgattagctgctgtctgattgaattgtcgcttgaggatgttttcagcttcataagcttgctgagtctggatacgcttgcgagtcggctgacgatagtcagccttgattccatgctccttcattattcgaatgatacgtttcttattcacattgtaagaaatttgttggctcaaattgattaacctagtcatcttgtcatagccaacactttgcttatgctcattctctaactgcttaattaattgaaaaatctctgactcttcgatttcgcgcttacttggcttatgtttgagccatttatagtaagcctgccttgttattccagctgctttggttaattcactaactgagtagccttcggctatcatttcctgaatcgcttgatatcgtccggtcgtttcacctcccgattttgtatttcggtagattgcaaatttaattaactcatagcaaaactcctggtattttacttagaagtcaataaattaattggactgctttatggtggtaagttacgacgtattttaacacctttaattataaggcacaaaaaaagtcattgaggccgtggaatccgacaccctcaatgacttacgcaacatgttaaagcactgattaaccactggcaatggttatttaagcgcactttagaagagcattacctctatcccagaaaggatgtggtaatgctccagacaccggacaagccggtagaagtattataacatgtaccggtttgtcctcaaacttaggaggataaacatatgaatcaatatacttaaaatttgaagatcgctaaatatactatgctcctcacggaaatacgcgaggatttcacggacaagaatagtctatcaatagcagactggttcttgtcaggctattcttgattatgaattaaccgtgcataatacccattataatttaacaattgtcgatgtgatccctgttcaacaatctttccatgatcaagaacgacaactttatcggtttgagacgcaatattgagacgatgtgctacaaaaattatcgttttgtctttcatgaataatagcttagagactattttatgttcagtaatggtgtctaaattactggttgattcgtcaaaaatgaaacattgtgccggagacaataatgctctagctattgataaccgctgtttttgcccaccagataagttgaatccactttcacttaatctagtatgataaccttgaggcaaattttctatatcagttttgatttcagcaaaggaacaagcttgatcaatcatttgttgagttactccaggacggctacctaacaataaattttctaatacagagcccgaaaaaatgaaaggttcttgaggaacataattaatatattggcgtaaaattgtgcgactaatatcagatatattgtgatgattaatctgaatttcaccgtgctgttcttgaggctcaaaaaaaccaactagcaacttggctagggtcgttttccccgaaccactcatgcctacaatagtaatcttctgatgatgtggaattgttagagaaacatcctcaagtatattagaacaatagccatagttaaaactaacatgattaacctcaatatcaccatttagttgctctagagcagttatttccctagatttagaaaattcagactctactagataaacctcatttaatcgattattagccactctggcagcttgtagtttaggctgtaaattaataatattttctaatggggtcaagaagtaagcgagcaaagcattataagttaacagctgacctaaagacagttggtgtcgcataacaaaaaaagtaccccaccaaaggataacaatagttaggattaatttagtagctgctttgatagcttgttgtccttgatcagctttttgataagccaagtttttatgcaataagtcagaaaatagtgtgtcaatctttttttttgtagttgcttcaccagttagtgatttaatggtttctatgccactgagactttcaataatagcagaattaagaactgcattgctttccattgtatcttgatttaaacgattaaaagtttttttaaatagccaaacaatcgagatgtaaattggaaccacaactaacgagcataaaaataaattgatgttttgataggccaaaaataaccctactgctaataaaatccacatgtctaaaaaaagggtgagcgttgtacttccaagtgcatcaataattttgcttgcatcagaaaagcgtgaggtcatttcaccgacatgacgggtagtaaaaaaattcattggtaaatcaaaaagatggtgaacgtattttaaaacgatgtcgatcatgagacgttgtcctaatacaatcgtaaaaaaactttgtatatagttgataattgcttggaaagcataagctacaatcagaccaatggcaactagtgaaagcctattagtcatcaagtgcggcaaataagtatcgataattaactgaaagaaatatgcaccagcaatactgattaatgttgttatagctgctgcggtaataattagtccaattaatcttttttgtttaatcaataaaggcactagatcaattaatgtgtgccgtgattcttttatgggtttatatttaactgttggggctatgataattgcaatctgggtccattctttagcaaattgtgatttcgatattttagtggttttaacggttggatcaggatcaccaataattaaatcgttttcagttacctgatagacaacatagtagtgtggtaacttatttttcttgaatacatgaacaatgactggtaatggcaattgtgaggctgtcaaagcatccatatcagcacgcacagcttcggcatttaaatttaagtgttttgctgctttaacaagccccaaaacagttgtaccgtcagcagttgttttggcaagctgtcgaagatgggccaacatgtaatcggagccatagtattttaggatcatatttagtgcagctaaaccacagtcattttcatcaacttgtgctgtataatatttgtgccatttttgagtccacataagcaaaccaccgatctttaaaatttgtgcataaaaaaagacgatttcaaagatccatcgccttttacattggttacaaaaccatattaaccaggtgactactgattattgtaatcagcagtaatctgttgtaaatcagataaagtggtatcatcaccagcggtcattgataccaccttaccattatcgagcaaggcaacagttggcgttcccataaaactcatgggggttgcaaaagttgaatagaaatcagttatttgtttttgagaagccatgctgaaagacccgttgttcccatagtctaagtaataaatgggatgctgactttgttgtaagtactgtttcatgactggagaaaatttacgacaatgcacacactccttgaacccgacaaagacaataaatttttctccagtttgagctttatgcaaatattgagttagcgtaataggaataacgcccctgatgttttcttcataagttgcaccatcgatgattttcgagctagtatttgattctatagtagcggaactgtcagcactcaccgatatggtagcaactcctgcaaaagcaagaaagacgcctaatgctaaaaagatatttgaccaaaatttcttagacaactacaatatcccctttatcagtactattggctaggccacgtattggtagtatctagcatgttaaactcgccccaccctttttgagaatgcgccaattcattgatggctgctagaactttgttttcttcggcagtaaaatgtaacttatctactaacgcttggctggcaatcttgttgtagactacacgagcttgtcgttcaggcgtttgctggttatgtttagttttactgataccagtctccagaatatctaaaacgtactggtaaggttcgatagtatcgtgcttctgtagtaaaaactgtagcctagtaaataagtccaaagcttgttgtttaatatgttccgacttagtcttattcataaaatcacccctttattgatgccagctcagcataatgctagcatttatgattaccttgatgtccaccagtagcccatgccatagctccattattgattatgcaagtggtagccttaccccagtcaacagagcaggaatgtttgccacaagtaaccccattaccgtagtatttaccaccaatgatattggccatttctttttcagttaatttttcaatttttttcatcacaaaaatctccttcttcttaaattatccttaatacgcgcttattctagttcccactcaatttaaatgtcaagtattagttagatattttcgcaccaaaactggttaacgatcttggtcaatttttgaaacctggctatcaacgcagtatcttttaagttatgacacagtttatatattcattttaaacgagaagaaatcgtgatcgaaagaaagcccggagatggtgcggctgcaactaccgatgtcaacaaacgcccggtcgttcgagaagaagttaacattcgtaaacaagaacacgaagatatgaaacaagtaagtgaaaacgtcggccgcgaagaactagatatcgatacgagtggtgatgcccacgtagaagacttacgcgataatgatcgcaacaagcatgaccggagctagtttctagctttgattttatcaaatcttttttggctctttgtgtgcgttcccgcaattaaaagccaaagaagccgaaaccaacgtgaaaacgttggtttcggcttcttttactgaatcaactaaaagaccacgtggtttccacgtctggttttactgctcttatactaaaaaaatggactatttttattcagtccgtaaaatgaaaatataggagcatttttatgtcaattcgttattcacaagatttcaaagattcattggttaaatttcaccaagaaggccgttcacttaaatcattaacagaataatttggaccttcaaaatattctattgctctttgggtcaagcaattagaaaagcgtctcgctattgttggaggaagaaaacaattttttgtgagcccttttgtaatgaaattcactgatttactattttatagccaataaaatgacaatccaatactatggttatggttgactgtaattgctttagttgaaaccttaaggcttacattaacttttaccagaatttccaccagcgtttaatagctctatttgtgtgtatgccatctttattactaccagatttaacaatcttctgtttagctattttgctttctttatcttggatgttaaaaagatcatttccggtcgacaagttgtcgttagttttttgagttagttgcccacttagcttttgtacatgatcttttaatcgacggttatctgctactgttgctaattgtaattgttgctgctgatccaccaattttgttagatgatctatttgtcggtctttggtagcaagctgtttgtcacgttgagactttaaatcttctatttctcttcttagagtggcaattagctcattattttctttgctagtctttgtcacttttttgctacctgtttgttgggtatttgctaccgaaggctttgctaccttgtccctaataatcctttcagctgtaaggctgatcatgtttgtaccttgactatctttttgtcggttctttgttggtagtctttggtagtggtattgaatagtttgtttagagaccttcaattcgtcagcaagttctctaattgttttaggcatgatttccaaacccctttcggagttcagcaagtgcttcttttcttgcttgatctcttatttttttatcatgttcggcttgtttgacagccaatgcttgcttttcagtagagcctaaagttaaccccttaactttatcaatggcacgccatttttcctgttctgttaattcgccattatgctgaatattaaagagtttttgacgttcatcttgaaattgaccttgtgagaagtcgttagcgtctttcttttcgggtttccaggtaaacgaatagccaataacaggctttcctcgccctttaccgtatttctttcggacagttagcccacgaaataggggggtaagttcttctttgattggttttatcacttttttgttaatgtcgccttgccgataagtttttggaatatcaagtaactcatcaaaatctgctttggaaaagtaagcgtacccagtagttctaaattgttttagtaaccgaaacattgtttttgcgtaactactttttaaatctctaaactctgccaacgcataacgaacccaactttctaaatcgtttagtaagtgtaaggctttaggataaactcggatatcaacgtaaggtatttcagcttcgcctttaatttcaaattcggtaaacataacaaaaaattctcgatttaagccacttttacttcgtctaccaaaatgtaatcccatcattttttcataagttctctgaatgtcatcttcaaaacggttatttgcagtaggtttataagcacttaactcttttaattgatcaaaagtaaaacgaacggtctgatctcccttatcacgcatacgagaaataatcgaaaaaaataaattcatttcaactggagtaaattttcgaagtggaatggtatttaactctggatcatatttaactagttcgttgctcaaaaaaccacctcctaaatcagaggctaccatatcaaggccggaacctcaagacgggacccccataaacagacaattggacccccataaacagacaattggacccctataaacagacaattggacccccataaacagacaattggacccccaaacatttgtgaaacgcttggtagagtaacgtggaacatgcccttaaaagaggtttaaaagaggtttataaaagaggtttaaaagatgcactactgtacgagggcaaaatctaaaacaaaaacacaaaggagtgagccaaaaaacaggctcacattaaactccagtcgctatgctccttgcgcctcactctgttcgttgcctaaaaggtgtggcaagccacattaattcgggcgctgacgccccgaaccccgtccaagctgagccagcttgaccgctttttcactcgccgttaggcaggaaagcaaagttttatagaaactttggctttcgccaattcagtgttaagactggtttagagctgtcaattccttatgctcccacgctttgctcgtccgctaccattgacagcaaacagttagttttttgaatctaaaaaagattttagctgctatgttcgtttttaagggtcttatttttcgtttctagcgattttaagaccattcatatacatttatatcaaagcaaaacaaaaagccctcagcaggcttttagagggttaaataacgaagccaggacgattaataatatcttcttgtcttttttgcaaaacataagtgtataaggaatcatacaagttccttttgatctcatcaggttcattgaaagaagcttcaaacaattcttgaatatcaacttgccaaggatcaacaagcatttcatcaattggttttaatactttcttttagtccagcttaattactcctaacattaaaataataatttcaatttagatacgcagttcttaaagttagttattcaaattttgttgccaggtttatgaagattctctgcacaaagcaattaaaaaaatttggttgaaagcagcgggatatgcaacaatttttagcgtttaaagcataacaaaatcagttaagtgtaagcataaattaaattaagaatacattccatttaacaacggcaaaaattgattttatggttatcataagaccgagttaaacaaggtcaatgcgcaattacacatagaatttattctatgttgtgctagacccattagagacctgtatcagaagtcgccgttggtgacaacaaaatcaaactaatttacccaaaatcaatttggttcaacatgttttctgtacttgcttggtctaagcctaaataagctagagtcatggcttcacttgaatgatttaataagtgcatgactaagccaatattgtaattggattgcgtataaacgcgataagccccagttttgcgcatcgtatgagtacctagataattaattcctaatagatcgccaaccttactcataattttgtagaactgtttttcagtaatatggcgttctgggtgttgaattgaaggaaagagccattcagaatccagcttatgatcaagcagccattgacggtacaataagagctctgtttgaacaggtttaaggtacaaggtattaggtttaccagtttttcggtcatgaataaacgcattttgtttaatagaaccgtccggattaaaaatatcggcctgttttaagcccataacgtcactcactcgcagtagcgtcgctttaccaacttgaaaaatcgtatagttacgtcggccagctttaaagttattgagtaacgtatcttgaacctctttaagaacgtttgaatctttgatgggtaagacaacttgtcgcatgtaaatgacctccggtaagaatatttgcattatgtatctacataggatatacttggtttttaataataatttaggagggggaaatatggaacctattaaagaacaaacacgcttagcaaagtggggaaactcgaaagctgctagaattcctagccaaattattaaacaactgaaattagatgataaccaagatatgacaataaccattgaaaatggatcaattgttttaacaccaataaaaaagaacccaaccaatattcacgaactatttaaggattggcaagatgacgggaaaagggatcacgagcttgattggggaaagtcagaaggtaatgaacttcaatggtaagccaaggtgatatattttatgttaactttaatccaagccgtggtcatgaacagatgaataagcgaccagccattgcgctaagcaatgatctagtctgtcagacaagtaacatgacgattgcggctccaattagcagtaccaagcgtaattttccaatgtatcatcgactaactagtagtcaaacagtatatggaaaagtattattagatcaaaccatagccttagatttacgggcaagacatgtcactgatgaaactattgtcgatcatgtatcgcgtgaagaactagaagaaataatcactttgtacaaattattgtttagtattgatgacaaatagaagaagttatttatttaatattaaaataaataacccccaacatctacattatagatattgggggttattttaacaatgattttgaggggcgatttgatagttatagaccctgaattaaggaatgttttagtgaccacccaggatcatagttgcatggcaacgtcctaccctcgcagggggcgatcccccaactactcttggcgttaagaagcttgacttctgtgttcgacatgggaacaggtatatccttctcactatcgtcaccacactctgtgctaacttgcgttatcacttgagaaaacttttgtcctctcaaaactgaataatatctacattctctttcgagttacttgccacgttctacttggttaagtcctcgaccgattagtactagtccgctccatgtatcgctacacttccacttctagcctatctacctgatcatctttcaggggtcttacttgcccgaaggcaatgggaaatctcatcttgaggcgagtttcacacttagatgctttcagcgtttatctcatccacacatagctacccagcgatgctcctggcggaacaactggtacaccagcggtgtgtccatcccggtcctctcgtactaaggacagctcctctcaaatttcctacgcccgcgacggatagggaccgaactgtctcacgacgttctgaacccagctcgcgtaccgctttaatgggcgaacagcccaacccttgggaccgactacagccccaggatgcgatgagccgacatcgaggtgccaaacctccccgtcgatgtgaactcttgggggagataagcctgttatccccagggtagcttttatccgttgagcgatggcccttccatacggaaccaccggatcactaagcccgactttcgtccctgctcgacctgtctgtctcgcagtcaagctcccttctgcctttacactctgcgaatgatttccaaccattctgagggaacctttgggcgcctccgttaccttttaggaggcgaccgccccagtcaaactgcccaccagacactgtctcccgccacgattagtggcgcgggttagagggttcatacaacgagggtagtatcccacttgcgcctcctccgaaactagcgttccggattctacggctcctacctattctgtacaagctgtacaaacactcaatatcaagttacagtaaagctccatggggtctttccgtcctgtcgcgggtaacccgcatcttcacgggtattataatttcaccgagtctctcgttgagacagtgcccagatcgttacgcctttcgtgcgggtcggaacttacccgacaaggaatttcgctaccttaggaccgttatagttacggccgccgtttactggggcttcagttcaaagcttcgcttacgctaactcatccccttaaccttccagcaccgggcaggcgtcagcccctatacgtcatcttacgattttgcagaaacctgtgtttttgataaacagtcgcctgggccttttcactgcggctgatcttgcgatcagcaccccttctcccgaagttacggggtcattttgccgagttccttaacgagagttctctcgctcaccttaggatactctcctcgactacctgtgtcggtttgcggtacgggtagttaaactctaactagaagcttttctcggcagcgtgacgtcaggaacttcgttacttaaatttcactccccatcaccgcttgtccttaagaaatcaagcatttgactcgatttcagacttacggcttggacacccacttccaatcgggtgcattccttagcctcctgcgtccctccattgttcaaacaagtttaactagtacaggaatctcaacctgttatccatcgcctacgcctctcggcctcggcttaggtcccgactaaccctgggaggacgagccttccccaggaaaccttagtcatacggtggataggattctcacctatctttcgctactcataccggcattctcacttctaagcgctccaacagtcctcacggtctgccttcgtcgcccttagaacgctctcctatcacgccacctaatggtggcatccacagtctcggtaatatgtttaagccccggtacattttcggcgcaggatcactcgactagtgagctattacgcactctttaaatggtggctgcttctgagccaacatcctagttgtctatgcaactccacatccttttccacttaacatatatttagggaccttaactggtggtctgggctgttcccctttcgacgatggatcttatcactcaccgtctgactcccggacataaatcgatggcattcggagtttatctgaattcggtaacccatgacgggcccctagtccaaacagtggctctacctccacgatcctaattccgaggctagccctaaagctatttcggagagaaccagctatctccaagttcgtttggaatttcaccgctacccacacctcatctcagcacttttcaacgtacacgagttcggtcctccagtgcgttttaccgcaccttcaacctggacatgggtaggtcacttggtttcgggtctacatccgcatactaattcgccctcttcagactcgctttcgcttcggctccgtctcttcaacttaacctggcatacgaacgtaactcgccggttcattctacaaaaggcacgccatcacccattaacgggctctgacttcttgtaggcacatggtttcaagaactatttcactccccttccggggtgcttttcacctttccctcacggtactggttcactatcggtcactaggtagtatttagccttgggagatggtcctcccggattccgacggaatttcacgtgctccgccgtactcaggatcctgaactgagggagcttgatttaacttacggggctgtcaccctctctggctggccttcccaggcccttcagctatcaagctctttggtaactcaaatgttcagtcctacaaccccaagaagcaagcctcttggtttgggctgttcccgtttcgctcgccgctactcagggaatcgaattttctttctgttcctgtgggtactgagatgtttcagttccccacgtttaccttcacacatcctatgaattcagatgcggataatagtcgattaaaactattgggttgccccattcggaaatccccggatcaaagcttacttacagctccccgaggcatatcggtgttagtcccgtccttcatcggctcctagtaccaaggcatccaccatgcgcccttcctaacttaacctaactttacctacggtaaagcgattaattgagtattgcgattattttgaactaatcttgtttaactctttaaaattacgcggttttctctcggtttaattatgattaattaaaattagaaaattatagatattattcagttttcaaagaacaaaagtggtagacctttgaaaactgaacaaaattttgacaaacgatcgtgtgaggactcgcaaatcaaattgatttagtgagaacaaacatgcgaagtcaattcgcaaaaacaaacaattaatgagcttgaaaaagactcatcattttaatatgagagtttgatcttggctcaggatgaacgctggcggcgtgcctaatacatgcaagtcgaacgaacttccgttaattgattatgacgtgcttgcactgaatgagattttaacacgaagtgagtggcggacgggtgagtaacacgtgggcaacctgcccagaagcaggggataacacctggaaacagatgctaataccgtataacagagaaaaccgcctggttttcttttaaaagatggctctgctatcacttctggatggacccgcggcgcattagctagttggtgaggtaacggctcaccaaggcgatgatgcgtagccgacctgagagggtaatcggccacattgggactgagacacggcccagactcctacgggaggcagcagtagggaatcttccacaatggacgcaagtctgatggagcaacgccgcgtgagtgaagaagggtttcggctcgtaaagctctgttgttaaagaagaacgtgggtgagagtaactgttcacccagtgacggtatttaaccagaaagccacggctaactacgtgccagcagccgcggtaatacgtaggtggcaagcgttatccggatttattgggcgtaaagcgagcgcaggcggtcttttaagtctaatgtgaaagccttcggctcaaccgaagaagtgcattggaaactgggagacttgagtgcagaagaggacagtggaactccatgtgtagcggtgaaatgcgtagatatatggaagaacaccagtggcgaaggcggctgtctggtctgtaactgacgctgaggctcgaaagcatgggtagcgaacaggattagataccctggtagtccatgccgtaaacgatgattactaagtgttggagggtttccgcccttcagtgctgcagctaacgcattaagtaatccgcctggggagtacgaccgcaaggttgaaactcaaaagaattgacgggggcccgcacaagcggtggagcatgtggtttaattcgaagctacgcgaagaaccttaccaggtcttgacatcttctgccaacctaagagattaggtgttcccttcggggacagaatgacaggtggtgcatggttgtcgtcagctcgtgtcgtgagatgttgggttaagtcccgcaacgagcgcaacccttattactagttgccagcattcagttgggcactctagtgagactgccggtgacaaaccggaggaaggtggggacgacgtcaaatcatcatgccccttatgacctgggctacacacgtgctacaatggatggtacaacgagtcgcgaaaccgcgaggtttagctaatctcttaaaaccattctcagttcggactgtaggctgcaactcgcctacacgaagtcggaatcgctagtaatcgcggatcagcatgccgcggtgaatacgttcccgggccttgtacacaccgcccgtcacaccatgagagtttgtaacacccaaagccggtggggtaaccttttaggagctagccgtctaaggtgggacagatgattagggtgaagtcgtaacaaggtagccgtaggagaacctgcggctggatcacctcctttctaaggaataatacggaaccgcacacgagtcaaagttttgtttagttttgagaggtctactctcaacgtttgcaaatattttgatttccttatcaaaactattgcatattactttacttaattttgaataaatttatataatgggcatataaaacaaaaaaggggtggatgaatttgaaaaaaattaatatcttattggcagcggaccgtaattatgctgacccactatgcattaccattaaaactgctttagaagccttaaattcagcaacacgggcccatttcattgttttaaccaacaaccttggtgaccaaacccgggcactgttagacaaattgatgcataattttcataccattgagtatttaaatcttgacgacgaacgttttgatttttgcccaacgaaccaacacatcaataaaaccgcatattttcgaatcatcgcccctaagctactagcttcacggcagattgatcgactaatttacttagacgttgacgttttgattcgaaaggacctaaccgaacttgccgaaagtaatttaaatggtaataccgtgggtgcggttattgatacgggacaggcttttgcattgcatcgcctaggtgtcgatcccgtggttgccgcaagtaatctatatttcaattccggaatcatggtgatcgatgttgcccggtggaacgcccatcgaatcacagaaaaaactttggcatttattagaaatcatgccgaccgaattattttccacgaccaagacgcgcttaatgccgtgttagctggggaagttcaatttcttcatccaaaatggaatttacaaaactcgattattttcagaaaacatcggccaatcaaccaggggtacgctgaactaatcgacgaagccattaaggaacctagcattgttcatttcactactcatgaaaaaccgtggaaggacctcaccgtccatccttatttagatgagtatcacgaagaacttggtgaattggaaatgcatcgtggagtgattaacgttatctcagcggcaaactcggcctttattcaaccgcttgccacatcttatatttcgattttagaaaatgatccagaacaccaatacaatttcttcttgttacccgatcacctgactgatcgcgacatgatgttattgggaagcatcattacccggtatgacaacgcgacgattaaaattgtagaagttaacgaagaattactagctaacgcggtagaaagcgaccgaatcgtcaaaacggcctactaccgcatcctagctcccgcattgttgccatccatcaaccgggcaatctacctcgactgcgacatcattgccaacacaagtttgcatgaattatggtaaaccaacttagagggcaacgtaattgctgccgtagaggatgctggattccacgacaggttggaaaaaatgggaatcactaaggaaaatgaaaagtactttaattcgggaatgatgttaattgaccttgtccgttggcgggcgaagtcaatcacccaaaaagtgttagattacatcaaccaaaaccccgaaaaattacgtttccacgatcaggacgcgttgaacgccatcctttacaacgattggctacacttgcatccccaatggaacgcccagtccaacattgtaatggaaaccattttcccaccgcggaccgaattgttggaaccttacgcagaaacacgtgaagatcctaagttaattcatttctgcggacacgtaaagccttggcacgaggattgtgaaaatccttacgccgaggtgtacctgaagtatcacgaaatggttagcaaccaaggtgtttctaagtcgacctctggttcggattcaatctctggttctggctcagattcaatctcgaagtcgacctctggttctgaatcaatctcggcttctggctcagattcaatttctaagtcaacttctggttcggattcactttcgaagtctgattctagctccgactcgctttcgaagtctgactctggttccgactcgatctcgaagtcgacctctggttcggattcactttcggcatccggttcggattcgatttctaagtcaacttctggctcggattcaatctcgaagtcaacttccggttcggactcgatttctggatcaggttccgattcgatttcgaagtcgacttctggttccgaatcaatctcgggctctggctcggattcgatttctaagtccacgtccggttcggattcactttcgaagtcggactctagctcggattcgatttctaggtcagcctctggttcggactcgatttcgaagtcgacctctggttctgattcgatttctaaatcaacttctggttcggattcactttcgaagtctgattctagctcggactcgatttcgaagtctgactctggttccgattcaatctcgaagtcgacttccggttcaggttcaatttcggcttccggttcggactcgatttctaagtcaacctctagctccgactcgtcgtctagatcagcctctggctcagactcaatctcgaagtcgacctctggttccggctcgatttcggcctctggttcggactcgatttcgaagtcaacctctggttctggctcgatttcagcttctggctcggattcaatctcgaagtcaacttctggttcggactcgttgtctagatcagcttctggttcggactcgatttctaagtcaacctctggttctggctcgatttcagcttctggctcggattcaatctcgaagtcaacttctagttcggactcgtcgtctagatcagcttctggttcggattcaatctctaagtcaacctctggttcagactcgatttcgaagtcaacttccggctcggattcgatttcgacctctggttctagttcggactcatcgaaccgttgttgttcgagtccgaatttgatccgctgttcgagccgctatcattcttatcggatgcagactgtgattcactctcttgcttgtcagacgtggacttcgattcgctttcttgcttgtcagatgctgacttcgattcgctttcttgcttatcagacgtcgacttcgattcactttcttgtttatcagatgtcgaacgtgattcactagcgatatcccgtgagtctgacttagaagctgaatcggaaatcgaagctgacttcgatgctgaatcggaatcagatgctgatctcgaaagcgagtccgaaccagaagccgaaatcgagctagaaccagaggtcgacttcgagattgaatctgagccagaggttgacttcgagattgaatccgaaccagaggttgacttcgaaattgagtcagagccagaagccgaaactgaactagagccagaagttgacttagaaatcgagtccgaaccagaagccgaaactgaactagaaccggaagtcgacttagaaatcgagtccgaaccagaggttgacttcgagattgaatccgagccagaggctgatctagacgtatgccaacggcgtaacgttgaccaacgatccaaatataatcaatctttgaggcgatcaattgaacagcgtcccatgatgattaatcaacgtaagcgcatcggcgattttgaactagatacagtcgttggtcctcgtgggcatagtagggcagttttattaactttaatcgatcgaaaatcacggttcctttgggcataccggttaaaagatcggacgacagcgactgttaatgaagcactaactaagttcctaaccacttttaatggtccggtgcacagctttactgtggaccgtggcactgagcttagtgggctagtatcacttgaatcacaatatggtattaagacctattactgccatgcttatactccagctgaacgtggtagtaatgaacgctttaatcggaatttacgttatttttatcttaaagggactcgttttgagcacattagtgctcaagatttaacgacgacgttactccaaattaaccagcgaccgcttaaaatactcgactggcaaacaccgtatcaggttatgctgacaaatttgtccaaaaattcgctcgaagtcgacttccggttcaggttcaatttcggcttccggttcggactcgatctcgaagtcaacctctagctccgactcgtcgtctagatcagcctctggctcagactcaatctcgaagtcgacctctggttccggctcgatttcggcctctggttcggactcgatttctaagtcaacctctggttctggctcgatttcagcttctggctcggattcaatctcgaagtcaacatctagttcggactcgtcgtctagatcagcttctggttccgattcaatctcgaagtcaacctctggttcagactcgatttcgaagtcaacttccggctcggattcgatttcgacctctggttctagttcggactcatcgtctagatcagcctctggctcggattcgatttctaagtcaacttctggctcggactcaatctcgaagtcaacttctgattccgactcgatatcttttaggagctgatcttttgtctagtataacctattccgaacgaattaaaatcgaaaccttttgtgaactagggctgtccaatatccaaatgggcgttcggctgaaccgatcaccgtcaacaatttcttatgaattatctcgatgtcaaccttatcaggctgaattagcacaaacagatgccgaatacaagcgatcacaatgtggtcggaaaactaagctgagcgatgagttaaagcaaaaaattctcaaccatttacgtctaagctggtcaccaggaatgattgctcacgaatttaaactagcgactaaatctatttataattggctaaatcaggggagaattggtttctccttgaatgatctacctgaacatggcgacaactcgaatgacggttctggaaataatcacggaactgaccaaggcaatggttcgaatggctcaggtgatggaacctggaatggcggtgctggcaacggcacaggtaacggtactaacggcggcaatggcaataccggcaacggcggagctagcctagtggatactggatatcaaccaggcaacggccaaggtgacggtagtgtcgaccttactcaaggtaatggtggcaacggcgcaaatagttcgaatggcggaacaaatagcgcagaacgcttaccacaaactggtgaggaagataacgctagtgctcgtgcagctggtacagttggcttgattggtggattactgccagcaccattgttggaaccgccgttattcgaatcagaacctgagccattgttcgagccgccgttatcggagtcagaaccggaaccgttattggatccatcgttgttcgagtcagagccagaaccgttgttggatccgtcgttattcgaatcagagttcgatccattgttagatccgttatcggagtcatcgttgttcgagttagaatctgagccgtctcctgaatgatggttgtggttatccgttgaatcagaaccggaaccattgttatcagaatcggagttacaactccgattctgataacaacggttccggttctgattcaacggataaccacaaccatcattcaggagatggctcagattctaactcgaacaacgatgactccgataacggatctaacaatggatcaaactctgattcgaataacgacggatccaacaacggttctggctctgactccgataacggcggctcgaacaatggctcaggttctgattcgaataacggcggttccaacaatggggctggtcagaacaactaacgttgttcaatggagaatagcgggatcgaaccgctgacctcctgcgtgcaaggcaggcgctctcccagctgagctaattccccatgtatgggcctaaatggactcgaaccatcgacctcacgcttatcaggcgtgcgctctaaccagctgagctataggcccgatacgcatgtgttttccggttctgactcaatttcgaagtcgatgtctggttccgattcagtttcggcctctggttcggattcgatttctaagtcaacttcgggctccgactcaatctcgaagtcgacctccggttcggattcaatctctggttctggctcagactcaattctgttgttgcgagggacaacgtcattgattcttcaaattgattgaaattaatccttgacataaattgctcctcacgatatacttaaaaagttgtgttaaacgacataaacgttgttaacacaacga

SEQ ID NO: 51-54 - skipped (4 entries)
